United States Patent 7,312,035 (METHODS OF GENETIC ANALYSIS OF YEAST) - sequence listing, part 4

SEQ ID NO: 118245 - DNA, 25 bp, S. cerevisiae
ggccaacttacttctgacaacgatc

SEQ ID NO: 118246 - DNA, 25 bp, S. cerevisiae
tgggtctcgcggtatcattgcagca

SEQ ID NO: 118247 - DNA, 25 bp, S. cerevisiae
ggttgagtactcaccagtcacagaa

SEQ ID NO: 118248 - DNA, 25 bp, S. cerevisiae
actggcgaactacttactctagctt

SEQ ID NO: 118249 - DNA, 25 bp, S. cerevisiae
tcgccgcatacactattctcagaat

SEQ ID NO: 118250 - DNA, 25 bp, S. cerevisiae
gagctaaccgcttttttgcacaaca

SEQ ID NO: 118251 - DNA, 25 bp, S. cerevisiae
gagtgataacactgcggccaactta

SEQ ID NO: 118252 - DNA, 25 bp, S. cerevisiae
cggctggctggtttattgctgataa

SEQ ID NO: 118253 - DNA, 25 bp, S. cerevisiae
atgcagtgctgccataaccatgagt

SEQ ID NO: 118254 - DNA, 25 bp, S. cerevisiae
ggtgagttttctccttcattacaga

SEQ ID NO: 118255 - DNA, 25 bp, S. cerevisiae
ggttgcattcgattcctgtttgtaa

SEQ ID NO: 118256 - DNA, 25 bp, S. cerevisiae
gatgcatggttactcaccactgcga

SEQ ID NO: 118257 - DNA, 25 bp, S. cerevisiae
aacagcgatcgcgtatttcgtctcg

SEQ ID NO: 118258 - DNA, 25 bp, S. cerevisiae
taatggctggcctgttgaacaagtc

SEQ ID NO: 118259 - DNA, 25 bp, S. cerevisiae
tcgctcaggcgcaatcacgaatgaa

SEQ ID NO: 118260 - DNA, 25 bp, S. cerevisiae
cggattcagtcgtcactcatggtga

SEQ ID NO: 118261 - DNA, 25 bp, S. cerevisiae
atcctatggaactgcctcggtgagt

SEQ ID NO: 118262 - DNA, 25 bp, S. cerevisiae
atcgcagaccgataccaggatcttg

SEQ ID NO: 118263 - DNA, 25 bp, S. cerevisiae
ataagcttttgccattctcaccgga

SEQ ID NO: 118264 - DNA, 25 bp, S. cerevisiae
atcaagcattttatccgtactcctg

SEQ ID NO: 118265 - DNA, 25 bp, S. cerevisiae
tataaactagcttctcaatctcccg

SEQ ID NO: 118266 - DNA, 25 bp, S. cerevisiae
ttatcgggagtttgtcattggagac

SEQ ID NO: 118267 - DNA, 25 bp, S. cerevisiae
tagtgacattacttcggccatgatg

SEQ ID NO: 118268 - DNA, 25 bp, S. cerevisiae
ggccatgatggtttcaactactaac

SEQ ID NO: 118269 - DNA, 25 bp, S. cerevisiae
acgctcccactattttgtcatttat

SEQ ID NO: 118270 - DNA, 25 bp, S. cerevisiae
acaaactagtggcatctgacgctcc

SEQ ID NO: 118271 - DNA, 25 bp, S. cerevisiae
aatcagttccggctattacttcatc

SEQ ID NO: 118272 - DNA, 25 bp, S. cerevisiae
taacgcccacaagaagcttttcata

SEQ ID NO: 118273 - DNA, 25 bp, S. cerevisiae
gaaatagtatcacgctcagctgaca

SEQ ID NO: 118274 - DNA, 25 bp, S. cerevisiae
caatctcccgttatatctgcaatag

SEQ ID NO: 118275 - DNA, 25 bp, S. cerevisiae
atactgtccatgaaataacgcccac

SEQ ID NO: 118276 - DNA, 25 bp, S. cerevisiae
tttgcggcttgcagagcacagaggc

SEQ ID NO: 118277 - DNA, 25 bp, S. cerevisiae
gaggccgcagaatgtgctctagatt

SEQ ID NO: 118278 - DNA, 25 bp, S. cerevisiae
aagagttcctcggtttgccagttat

SEQ ID NO: 118279 - DNA, 25 bp, S. cerevisiae
aacatactactcagtgcagcttcac

SEQ ID NO: 118280 - DNA, 25 bp, S. cerevisiae
tacttggttggcgtgtttcgtaatc

SEQ ID NO: 118281 - DNA, 25 bp, S. cerevisiae
gaactcgatttctgactgggttgga

SEQ ID NO: 118282 - DNA, 25 bp, S. cerevisiae
gaaacctcattcgtttattcccttg

SEQ ID NO: 118283 - DNA, 25 bp, S. cerevisiae
cggcattgatatcgtccaactgcat

SEQ ID NO: 118284 - DNA, 25 bp, S. cerevisiae
attccgatgctgacttgctgggtat

SEQ ID NO: 118285 - DNA, 25 bp, S. cerevisiae
agttcaggcactccgaaatacttgg

SEQ ID NO: 118286 - DNA, 25 bp, S. cerevisiae
aggatgttttggctctggtcaatga

SEQ ID NO: 118287 - DNA, 25 bp, S. cerevisiae
tttgcactactggaaaactacctgt

SEQ ID NO: 118288 - DNA, 25 bp, S. cerevisiae
gtgatgcaacatacggaaaacttac

SEQ ID NO: 118289 - DNA, 25 bp, S. cerevisiae
gtccttcttgagtttgtaacagctg

SEQ ID NO: 118290 - DNA, 25 bp, S. cerevisiae
tgcaacatacggaaaacttaccctt

SEQ ID NO: 118291 - DNA, 25 bp, S. cerevisiae
gaccacatggtccttcttgagtttg

SEQ ID NO: 118292 - DNA, 25 bp, S. cerevisiae
gagagaccacatggtccttcttgag

SEQ ID NO: 118293 - DNA, 25 bp, S. cerevisiae
catggtccttcttgagtttgtaaca

SEQ ID NO: 118294 - DNA, 25 bp, S. cerevisiae
ctggaaaactacctgttccatggcc

SEQ ID NO: 118295 - DNA, 25 bp, S. cerevisiae
cttgagtttgtaacagctgctggga

SEQ ID NO: 118296 - DNA, 25 bp, S. cerevisiae
agatcccaacgaaaagagagaccac

SEQ ID NO: 118297 - DNA, 25 bp, S. cerevisiae
agagggtgaaggtgatgcaacatac

SEQ ID NO: 118298 - DNA, 25 bp, S. cerevisiae
gatctggccgatgtggattgcgaaa

SEQ ID NO: 118299 - DNA, 25 bp, S. cerevisiae
aaagctgcctgttccaaaggtcctg

SEQ ID NO: 118300 - DNA, 25 bp, S. cerevisiae
aaaggtcctgcactttgaacggcat

SEQ ID NO: 118301 - DNA, 25 bp, S. cerevisiae
gacactccatttaaagatccgcgcg

SEQ ID NO: 118302 - DNA, 25 bp, S. cerevisiae
ccgcgcgagctgtatgattttttaa

SEQ ID NO: 118303 - DNA, 25 bp, S. cerevisiae
gaagaggaacttgtcttttcccacg

SEQ ID NO: 118304 - DNA, 25 bp, S. cerevisiae
gacagccgcttagccgaattggatt

SEQ ID NO: 118305 - DNA, 25 bp, S. cerevisiae
atcggattgtccctatacgaatagc

SEQ ID NO: 118306 - DNA, 25 bp, S. cerevisiae
atgcggagtgcatcaggctctttca

SEQ ID NO: 118307 - DNA, 25 bp, S. cerevisiae
atggcgtcctttgctcggaagagta

SEQ ID NO: 118308 - DNA, 25 bp, S. cerevisiae
agtggtatgacattgccttctgcgt

SEQ ID NO: 118309 - DNA, 25 bp, S. cerevisiae
tgaccaaattagagtgccttttaaa

SEQ ID NO: 118310 - DNA, 25 bp, S. cerevisiae
aaagcaatttagaaccactggcaaa

SEQ ID NO: 118311 - DNA, 25 bp, S. cerevisiae
aactactaattacagctttgagctt

SEQ ID NO: 118312 - DNA, 25 bp, S. cerevisiae
aaccctgattttgcttatttagtca

SEQ ID NO: 118313 - DNA, 25 bp, S. cerevisiae
tatgctaaaacactttaccgccttt

SEQ ID NO: 118314 - DNA, 25 bp, S. cerevisiae
gaaccactggcaaagcttattttga

SEQ ID NO: 118315 - DNA, 25 bp, S. cerevisiae
gaacagcaatctttttgaccaaatt

SEQ ID NO: 118316 - DNA, 25 bp, S. cerevisiae
gcttattttgagtgggacgagtttt

SEQ ID NO: 118317 - DNA, 25 bp, S. cerevisiae
gaagaatttatagcccttagcggta

SEQ ID NO: 118318 - DNA, 25 bp, S. cerevisiae
gcgtggcggcaaagtttcaggcatt

SEQ ID NO: 118319 - DNA, 25 bp, S. cerevisiae
atggattttaaacctgctatcaaag

SEQ ID NO: 118320 - DNA, 25 bp, S. cerevisiae
ggaccagagcataaattaacgcaaa

SEQ ID NO: 118321 - DNA, 25 bp, S. cerevisiae
acgcaaatgcccctagaattgaaaa

SEQ ID NO: 118322 - DNA, 25 bp, S. cerevisiae
aagcattgcttcaaagaataccagg

SEQ ID NO: 118323 - DNA, 25 bp, S. cerevisiae
taaaaactttgtttgaggcacacaa

SEQ ID NO: 118324 - DNA, 25 bp, S. cerevisiae
tacaacgccaaagtaagagaagact

SEQ ID NO: 118325 - DNA, 25 bp, S. cerevisiae
gactatcagttaacaaagaatgctt

SEQ ID NO: 118326 - DNA, 25 bp, S. cerevisiae
gaactaggacacgaaagagctttaa

SEQ ID NO: 118327 - DNA, 25 bp, S. cerevisiae
gcttttttaattagcacagatgaaa

SEQ ID NO: 118328 - DNA, 25 bp, S. cerevisiae
gaataccaggaccagagcataaatt

SEQ ID NO: 118329 - DNA, 25 bp, S. cerevisiae
agtttgaaaagcgtttaagcctatg

SEQ ID NO: 118330 - DNA, 25 bp, S. cerevisiae
agagctttaaaggaacttacacaag

SEQ ID NO: 118331 - DNA, 25 bp, S. cerevisiae
tttcggttatggtcttcaatgcttt

SEQ ID NO: 118332 - DNA, 25 bp, S. cerevisiae
tactttcggttatggtcttcaatgc

SEQ ID NO: 118333 - DNA, 25 bp, S. cerevisiae
tgtcactactttcggttatggtctt

SEQ ID NO: 118334 - DNA, 25 bp, S. cerevisiae
gttatggtcttcaatgctttgcaag

SEQ ID NO: 118335 - DNA, 25 bp, S. cerevisiae
actactttcggttatggtcttcaat

SEQ ID NO: 118336 - DNA, 25 bp, S. cerevisiae
aaccattacctgtcctaccaatctg

SEQ ID NO: 118337 - DNA, 25 bp, S. cerevisiae
tcggttatggtcttcaatgctttgc

SEQ ID NO: 118338 - DNA, 25 bp, S. cerevisiae
cactactttcggttatggtcttcaa

SEQ ID NO: 118339 - DNA, 25 bp, S. cerevisiae
cttgtcactactttcggttatggtc

SEQ ID NO: 118340 - DNA, 25 bp, S. cerevisiae
cggttatggtcttcaatgctttgca

SEQ ID NO: 118341 - DNA, 25 bp, S. cerevisiae
ctttcggttatggtcttcaatgctt

SEQ ID NO: 118342 - DNA, 25 bp, S. cerevisiae
taggtggcatgcgtggtctcgacat

SEQ ID NO: 118343 - DNA, 25 bp, S. cerevisiae
gtgccatggttctcagtggtgtcaa

SEQ ID NO: 118344 - DNA, 25 bp, S. cerevisiae
gataatcggcggtatggagctgtct

SEQ ID NO: 118345 - DNA, 25 bp, S. cerevisiae
aactcttttctgctatggtcatgcg

SEQ ID NO: 118346 - DNA, 25 bp, S. cerevisiae
aattgatggctttaaccgcatgggc

SEQ ID NO: 118347 - DNA, 25 bp, S. cerevisiae
aagtcttcctgaacgagctgggtgt

SEQ ID NO: 118348 - DNA, 25 bp, S. cerevisiae
gacactcatgtcgaaggttctctcc

SEQ ID NO: 118349 - DNA, 25 bp, S. cerevisiae
cccagattgctggtgttgtcgtcaa

SEQ ID NO: 118350 - DNA, 25 bp, S. cerevisiae
atgctaccgctgttgaggacttgat

SEQ ID NO: 118351 - DNA, 25 bp, S. cerevisiae
atgtcaagctcttcaatgctaccgc

SEQ ID NO: 118352 - DNA, 25 bp, S. cerevisiae
agtaccactggtcacgatgggccat

SEQ ID NO: 118353 - DNA, 25 bp, S. cerevisiae
ttagccgggctgcactcaatgtaca

SEQ ID NO: 118354 - DNA, 25 bp, S. cerevisiae
gtccgatcacctgcgtcaatgtaat

SEQ ID NO: 118355 - DNA, 25 bp, S. cerevisiae
ggcggcttttctgctgcaaaaacgc

SEQ ID NO: 118356 - DNA, 25 bp, S. cerevisiae
tggatatgtatcaccgcgtctttga

SEQ ID NO: 118357 - DNA, 25 bp, S. cerevisiae
aaacgctggactggcatgaacttcg

SEQ ID NO: 118358 - DNA, 25 bp, S. cerevisiae
aaaagaacttctggcctggcaggag

SEQ ID NO: 118359 - DNA, 25 bp, S. cerevisiae
caatgtaatgttctgcgacgctcac

SEQ ID NO: 118360 - DNA, 25 bp, S. cerevisiae
gaagcaacgcgtaaactcgacccga

SEQ ID NO: 118361 - DNA, 25 bp, S. cerevisiae
gcatcagccgattatcatcaccgaa

SEQ ID NO: 118362 - DNA, 25 bp, S. cerevisiae
agaaagggatcttcactcgcgaccg

SEQ ID NO: 118363 - DNA, 25 bp, S. cerevisiae
atgtgctgtgcctgaaccgttatta

SEQ ID NO: 118364 - DNA, 25 bp, S. cerevisiae
ttgactgactacttgatgaagatct

SEQ ID NO: 118365 - DNA, 25 bp, S. cerevisiae
ttacgctggtttctctctacctcac

SEQ ID NO: 118366 - DNA, 25 bp, S. cerevisiae
tttgagaatcgatttggccggtaga

SEQ ID NO: 118367 - DNA, 25 bp, S. cerevisiae
tttggccggtagagatttgactgac

SEQ ID NO: 118368 - DNA, 25 bp, S. cerevisiae
ttgtccgtgacatcaaggaaaaact

SEQ ID NO: 118369 - DNA, 25 bp, S. cerevisiae
tttctccaccactgctgaaagagaa

SEQ ID NO: 118370 - DNA, 25 bp, S. cerevisiae
gtccgtgacatcaaggaaaaactat

SEQ ID NO: 118371 - DNA, 25 bp, S. cerevisiae
gtggttactctttctccaccactgc

SEQ ID NO: 118372 - DNA, 25 bp, S. cerevisiae
tggtttctctctacctcacgccatt

SEQ ID NO: 118373 - DNA, 25 bp, S. cerevisiae
ggttactctttctccaccactgctg

SEQ ID NO: 118374 - DNA, 25 bp, S. cerevisiae
tggtgttactcacgtcgttccaatt

SEQ ID NO: 118375 - DNA, 25 bp, S. cerevisiae
gatggtgttactcacgtcgttccaa

SEQ ID NO: 118376 - DNA, 25 bp, S. cerevisiae
gatcttgagtgaacgtggttactct

SEQ ID NO: 118377 - DNA, 25 bp, S. cerevisiae
gatttggccggtagagatttgactg

SEQ ID NO: 118378 - DNA, 25 bp, S. cerevisiae
acgctggtttctctctacctcacgc

SEQ ID NO: 118379 - DNA, 25 bp, S. cerevisiae
aaaccgctgctcaatcttcttcaat

SEQ ID NO: 118380 - DNA, 25 bp, S. cerevisiae
aaatgcaaaccgctgctcaatcttc

SEQ ID NO: 118381 - DNA, 25 bp, S. cerevisiae
accgctgctcaatcttcttcaattg

SEQ ID NO: 118382 - DNA, 25 bp, S. cerevisiae
acctcacgccattttgagaatcgat

SEQ ID NO: 118383 - DNA, 25 bp, S. cerevisiae
aatcgatttggccggtagagatttg

SEQ ID NO: 118384 - DNA, 25 bp, S. cerevisiae
aagatcttgagtgaacgtggttact

SEQ ID NO: 118385 - DNA, 25 bp, S. cerevisiae
tactcacgtcgttccaatttacgct

SEQ ID NO: 118386 - DNA, 25 bp, S. cerevisiae
tccaatttacgctggtttctctcta

SEQ ID NO: 118387 - DNA, 25 bp, S. cerevisiae
tcgatttggccggtagagatttgac

SEQ ID NO: 118388 - DNA, 25 bp, S. cerevisiae
tctccaccactgctgaaagagaaat

SEQ ID NO: 118389 - DNA, 25 bp, S. cerevisiae
tccaccactgctgaaagagaaattg

SEQ ID NO: 118390 - DNA, 25 bp, S. cerevisiae
tgagaatcgatttggccggtagaga

SEQ ID NO: 118391 - DNA, 25 bp, S. cerevisiae
tcaatcttcttcaattgaaaaatcc

SEQ ID NO: 118392 - DNA, 25 bp, S. cerevisiae
gaaattgtccgtgacatcaaggaaa

SEQ ID NO: 118393 - DNA, 25 bp, S. cerevisiae
gactgactacttgatgaagatcttg

SEQ ID NO: 118394 - DNA, 25 bp, S. cerevisiae
ctcacgccattttgagaatcgattt

SEQ ID NO: 118395 - DNA, 25 bp, S. cerevisiae
caccactgctgaaagagaaattgtc

SEQ ID NO: 118396 - DNA, 25 bp, S. cerevisiae
ctgactacttgatgaagatcttgag

SEQ ID NO: 118397 - DNA, 25 bp, S. cerevisiae
ctgctcaatcttcttcaattgaaaa

SEQ ID NO: 118398 - DNA, 25 bp, S. cerevisiae
cgctgctcaatcttcttcaattgaa

SEQ ID NO: 118399 - DNA, 25 bp, S. cerevisiae
cgccattttgagaatcgatttggcc

SEQ ID NO: 118400 - DNA, 25 bp, S. cerevisiae
ctcacgtcgttccaatttacgctgg

SEQ ID NO: 118401 - DNA, 25 bp, S. cerevisiae
ctacttgatgaagatcttgagtgaa

SEQ ID NO: 118402 - DNA, 25 bp, S. cerevisiae
cacgccattttgagaatcgatttgg

SEQ ID NO: 118403 - DNA, 25 bp, S. cerevisiae
ccattttgagaatcgatttggccgg

SEQ ID NO: 118404 - DNA, 25 bp, S. cerevisiae
ctacctcacgccattttgagaatcg

SEQ ID NO: 118405 - DNA, 25 bp, S. cerevisiae
ccttggacttcgaacaagaaatgca

SEQ ID NO: 118406 - DNA, 25 bp, S. cerevisiae
caagaaatgcaaaccgctgctcaat

SEQ ID NO: 118407 - DNA, 25 bp, S. cerevisiae
gctcaatcttcttcaattgaaaaat

SEQ ID NO: 118408 - DNA, 25 bp, S. cerevisiae
gctggtttctctctacctcacgcca

SEQ ID NO: 118409 - DNA, 25 bp, S. cerevisiae
gcaaaccgctgctcaatcttcttca

SEQ ID NO: 118410 - DNA, 25 bp, S. cerevisiae
atttgactgactacttgatgaagat

SEQ ID NO: 118411 - DNA, 25 bp, S. cerevisiae
atgcaaaccgctgctcaatcttctt

SEQ ID NO: 118412 - DNA, 25 bp, S. cerevisiae
agaatcgatttggccggtagagatt

SEQ ID NO: 118413 - DNA, 25 bp, S. cerevisiae
agatttgactgactacttgatgaag

SEQ ID NO: 118414 - DNA, 25 bp, S. cerevisiae
ttgagagttgccccagaagaacacc

SEQ ID NO: 118415 - DNA, 25 bp, S. cerevisiae
tagaccaagacaccaaggtatcatg

SEQ ID NO: 118416 - DNA, 25 bp, S. cerevisiae
taccttctacaacgaattgagagtt

SEQ ID NO: 118417 - DNA, 25 bp, S. cerevisiae
ttctacaacgaattgagagttgccc

SEQ ID NO: 118418 - DNA, 25 bp, S. cerevisiae
ttgccggtgacgacgctcctcgtgc

SEQ ID NO: 118419 - DNA, 25 bp, S. cerevisiae
ttttgccggtgacgacgctcctcgt

SEQ ID NO: 118420 - DNA, 25 bp, S. cerevisiae
ttgctgctttggttattgataacgg

SEQ ID NO: 118421 - DNA, 25 bp, S. cerevisiae
ttgaacacggtattgtcaccaactg

SEQ ID NO: 118422 - DNA, 25 bp, S. cerevisiae
tgataacggttctggtatgtgtaaa

SEQ ID NO: 118423 - DNA, 25 bp, S. cerevisiae
gtgacgacgctcctcgtgctgtctt

SEQ ID NO: 118424 - DNA, 25 bp, S. cerevisiae
gtgatgaagctcaatccaagagagg

SEQ ID NO: 118425 - DNA, 25 bp, S. cerevisiae
ggtatcatggtcggtatgggtcaaa

SEQ ID NO: 118426 - DNA, 25 bp, S. cerevisiae
tcatggtcggtatgggtcaaaaaga

SEQ ID NO: 118427 - DNA, 25 bp, S. cerevisiae
gatctggcatcataccttctacaac

SEQ ID NO: 118428 - DNA, 25 bp, S. cerevisiae
actcctacgttggtgatgaagctca

SEQ ID NO: 118429 - DNA, 25 bp, S. cerevisiae
aaggtatcatggtcggtatgggtca

SEQ ID NO: 118430 - DNA, 25 bp, S. cerevisiae
aattgagagttgccccagaagaaca

SEQ ID NO: 118431 - DNA, 25 bp, S. cerevisiae
aagacaccaaggtatcatggtcggt

SEQ ID NO: 118432 - DNA, 25 bp, S. cerevisiae
aagctcaatccaagagaggtatctt

SEQ ID NO: 118433 - DNA, 25 bp, S. cerevisiae
tcaaaaagactcctacgttggtgat

SEQ ID NO: 118434 - DNA, 25 bp, S. cerevisiae
tcctcgtgctgtcttcccatctatc

SEQ ID NO: 118435 - DNA, 25 bp, S. cerevisiae
tgccccagaagaacaccctgttctt

SEQ ID NO: 118436 - DNA, 25 bp, S. cerevisiae
tcggtagaccaagacaccaaggtat

SEQ ID NO: 118437 - DNA, 25 bp, S. cerevisiae
tctggtatgtgtaaagccggttttg

SEQ ID NO: 118438 - DNA, 25 bp, S. cerevisiae
tgctgtcttcccatctatcgtcggt

SEQ ID NO: 118439 - DNA, 25 bp, S. cerevisiae
tcaatccaagagaggtatcttgact

SEQ ID NO: 118440 - DNA, 25 bp, S. cerevisiae
tgaagctcaatccaagagaggtatc

SEQ ID NO: 118441 - DNA, 25 bp, S. cerevisiae
tcccatctatcgtcggtagaccaag

SEQ ID NO: 118442 - DNA, 25 bp, S. cerevisiae
tcctacgttggtgatgaagctcaat

SEQ ID NO: 118443 - DNA, 25 bp, S. cerevisiae
gagttgccccagaagaacaccctgt

SEQ ID NO: 118444 - DNA, 25 bp, S. cerevisiae
gacgacgctcctcgtgctgtcttcc

SEQ ID NO: 118445 - DNA, 25 bp, S. cerevisiae
ccaattgaacacggtattgtcacca

SEQ ID NO: 118446 - DNA, 25 bp, S. cerevisiae
ccaaggtatcatggtcggtatgggt

SEQ ID NO: 118447 - DNA, 25 bp, S. cerevisiae
caccaaggtatcatggtcggtatgg

SEQ ID NO: 118448 - DNA, 25 bp, S. cerevisiae
cgtgctgtcttcccatctatcgtcg

SEQ ID NO: 118449 - DNA, 25 bp, S. cerevisiae
ctacaacgaattgagagttgcccca

SEQ ID NO: 118450 - DNA, 25 bp, S. cerevisiae
ctcgtgctgtcttcccatctatcgt

SEQ ID NO: 118451 - DNA, 25 bp, S. cerevisiae
ccaagacaccaaggtatcatggtcg

SEQ ID NO: 118452 - DNA, 25 bp, S. cerevisiae
ccatctatcgtcggtagaccaagac

SEQ ID NO: 118453 - DNA, 25 bp, S. cerevisiae
cataccttctacaacgaattgagag

SEQ ID NO: 118454 - DNA, 25 bp, S. cerevisiae
ctatcgtcggtagaccaagacacca

SEQ ID NO: 118455 - DNA, 25 bp, S. cerevisiae
gccggtgacgacgctcctcgtgctg

SEQ ID NO: 118456 - DNA, 25 bp, S. cerevisiae
gctcaatccaagagaggtatcttga

SEQ ID NO: 118457 - DNA, 25 bp, S. cerevisiae
gaccaagacaccaaggtatcatggt

SEQ ID NO: 118458 - DNA, 25 bp, S. cerevisiae
gagagttgccccagaagaacaccct

SEQ ID NO: 118459 - DNA, 25 bp, S. cerevisiae
gcatcataccttctacaacgaattg

SEQ ID NO: 118460 - DNA, 25 bp, S. cerevisiae
attgataacggttctggtatgtgta

SEQ ID NO: 118461 - DNA, 25 bp, S. cerevisiae
cttcccatctatcgtcggtagacca

SEQ ID NO: 118462 - DNA, 25 bp, S. cerevisiae
atcataccttctacaacgaattgag

SEQ ID NO: 118463 - DNA, 25 bp, S. cerevisiae
atcgtcggtagaccaagacaccaag

SEQ ID NO: 118464 - DNA, 25 bp, S. cerevisiae
agactcctacgttggtgatgaagct

SEQ ID NO: 118465 - DNA, 25 bp, S. cerevisiae
ttccaacaaatgtggatctcaaaac

SEQ ID NO: 118466 - DNA, 25 bp, S. cerevisiae
taccttccaacaaatgtggatctca

SEQ ID NO: 118467 - DNA, 25 bp, S. cerevisiae
taccaccatgttcccaggtattgcc

SEQ ID NO: 118468 - DNA, 25 bp, S. cerevisiae
tatacggtaacatcgttatgtccgg

SEQ ID NO: 118469 - DNA, 25 bp, S. cerevisiae
ttcccaggtattgccgaaagaatgc

SEQ ID NO: 118470 - DNA, 25 bp, S. cerevisiae
tttgactaccttccaacaaatgtgg

SEQ ID NO: 118471 - DNA, 25 bp, S. cerevisiae
ttggctccatcttccatgaaggtca

SEQ ID NO: 118472 - DNA, 25 bp, S. cerevisiae
gtgatgtcgatgtccgtaaggaatt

SEQ ID NO: 118473 - DNA, 25 bp, S. cerevisiae
gtactccgtctggattggtggttct

SEQ ID NO: 118474 - DNA, 25 bp, S. cerevisiae
ggtccatctatcgttcaccacaagt

SEQ ID NO: 118475 - DNA, 25 bp, S. cerevisiae
ggtggttctatcttggcttctttga

SEQ ID NO: 118476 - DNA, 25 bp, S. cerevisiae
gtggtccatctatcgttcaccacaa

SEQ ID NO: 118477 - DNA, 25 bp, S. cerevisiae
tgtcgatgtccgtaaggaattatac

SEQ ID NO: 118478 - DNA, 25 bp, S. cerevisiae
tggattggtggttctatcttggctt

SEQ ID NO: 118479 - DNA, 25 bp, S. cerevisiae
tgttcccaggtattgccgaaagaat

SEQ ID NO: 118480 - DNA, 25 bp, S. cerevisiae
gatgtcgatgtccgtaaggaattat

SEQ ID NO: 118481 - DNA, 25 bp, S. cerevisiae
gattggtggttctatcttggcttct

SEQ ID NO: 118482 - DNA, 25 bp, S. cerevisiae
gatcattgctcctccagaaagaaag

SEQ ID NO: 118483 - DNA, 25 bp, S. cerevisiae
gttctatcttggcttctttgactac

SEQ ID NO: 118484 - DNA, 25 bp, S. cerevisiae
actccgtctggattggtggttctat

SEQ ID NO: 118485 - DNA, 25 bp, S. cerevisiae
actaccttccaacaaatgtggatct

SEQ ID NO: 118486 - DNA, 25 bp, S. cerevisiae
aatcaccgctttggctccatcttcc

SEQ ID NO: 118487 - DNA, 25 bp, S. cerevisiae
aagtgtgatgtcgatgtccgtaagg

SEQ ID NO: 118488 - DNA, 25 bp, S. cerevisiae
tgactaccttccaacaaatgtggat

SEQ ID NO: 118489 - DNA, 25 bp, S. cerevisiae
tacgacgaaagtggtccatctatcg

SEQ ID NO: 118490 - DNA, 25 bp, S. cerevisiae
tgctcctccagaaagaaagtactcc

SEQ ID NO: 118491 - DNA, 25 bp, S. cerevisiae
tcttggcttctttgactaccttcca

SEQ ID NO: 118492 - DNA, 25 bp, S. cerevisiae
tatgtccggtggtaccaccatgttc

SEQ ID NO: 118493 - DNA, 25 bp, S. cerevisiae
tccatctatcgttcaccacaagtgt

SEQ ID NO: 118494 - DNA, 25 bp, S. cerevisiae
tacggtaacatcgttatgtccggtg

SEQ ID NO: 118495 - DNA, 25 bp, S. cerevisiae
tcattgctcctccagaaagaaagta

SEQ ID NO: 118496 - DNA, 25 bp, S. cerevisiae
tcaccgctttggctccatcttccat

SEQ ID NO: 118497 - DNA, 25 bp, S. cerevisiae
gaaagtactccgtctggattggtgg

SEQ ID NO: 118498 - DNA, 25 bp, S. cerevisiae
gaaagaaagtactccgtctggattg

SEQ ID NO: 118499 - DNA, 25 bp, S. cerevisiae
gaaagtggtccatctatcgttcacc

SEQ ID NO: 118500 - DNA, 25 bp, S. cerevisiae
tcgatgtccgtaaggaattatacgg

SEQ ID NO: 118501 - DNA, 25 bp, S. cerevisiae
cgtctggattggtggttctatcttg

SEQ ID NO: 118502 - DNA, 25 bp, S. cerevisiae
catctatcgttcaccacaagtgttt

SEQ ID NO: 118503 - DNA, 25 bp, S. cerevisiae
ctttggctccatcttccatgaaggt

SEQ ID NO: 118504 - DNA, 25 bp, S. cerevisiae
cgctttggctccatcttccatgaag

SEQ ID NO: 118505 - DNA, 25 bp, S. cerevisiae
cgacgaaagtggtccatctatcgtt

SEQ ID NO: 118506 - DNA, 25 bp, S. cerevisiae
ccaacaaatgtggatctcaaaacaa

SEQ ID NO: 118507 - DNA, 25 bp, S. cerevisiae
ccatcttccatgaaggtcaagatca

SEQ ID NO: 118508 - DNA, 25 bp, S. cerevisiae
ctatcgttcaccacaagtgtttcta

SEQ ID NO: 118509 - DNA, 25 bp, S. cerevisiae
caggtattgccgaaagaatgcaaaa

SEQ ID NO: 118510 - DNA, 25 bp, S. cerevisiae
gaattatacggtaacatcgttatgt

SEQ ID NO: 118511 - DNA, 25 bp, S. cerevisiae
atcatgaagtgtgatgtcgatgtcc

SEQ ID NO: 118512 - DNA, 25 bp, S. cerevisiae
tccggtggtaccaccatgttcccag

SEQ ID NO: 118513 - DNA, 25 bp, S. cerevisiae
atcttccatgaaggtcaagatcatt

SEQ ID NO: 118514 - DNA, 25 bp, S. cerevisiae
cttccatgaaggtcaagatcattgc

SEQ ID NO: 118515 - DNA, 25 bp, S. cerevisiae
aggaaatcaccgctttggctccatc

SEQ ID NO: 118516 - DNA, 25 bp, S. cerevisiae
ttgctgctgtcatcatgcgtattag

SEQ ID NO: 118517 - DNA, 25 bp, S. cerevisiae
ttgcgctacatgcccgtaatgcaga

SEQ ID NO: 118518 - DNA, 25 bp, S. cerevisiae
tttgctgctgtcatcatgcgtatta

SEQ ID NO: 118519 - DNA, 25 bp, S. cerevisiae
ttaccggtgcaaaaagtgaggatga

SEQ ID NO: 118520 - DNA, 25 bp, S. cerevisiae
tttgctgctaaattcacagacttca

SEQ ID NO: 118521 - DNA, 25 bp, S. cerevisiae
ttgctgctaaattcacagacttcaa

SEQ ID NO: 118522 - DNA, 25 bp, S. cerevisiae
gtcatcatgcgtattagagagccaa

SEQ ID NO: 118523 - DNA, 25 bp, S. cerevisiae
ggtttgctgctaaattcacagactt

SEQ ID NO: 118524 - DNA, 25 bp, S. cerevisiae
gttaccggtgcaaaaagtgaggatg

SEQ ID NO: 118525 - DNA, 25 bp, S. cerevisiae
gttgcgctacatgcccgtaatgcag

SEQ ID NO: 118526 - DNA, 25 bp, S. cerevisiae
gttttgctgctgtcatcatgcgtat

SEQ ID NO: 118527 - DNA, 25 bp, S. cerevisiae
caaagctggccagtagaaaatatgc

SEQ ID NO: 118528 - DNA, 25 bp, S. cerevisiae
accccaagcgttttgctgctgtcat

SEQ ID NO: 118529 - DNA, 25 bp, S. cerevisiae
acagttgcgctacatgcccgtaatg

SEQ ID NO: 118530 - DNA, 25 bp, S. cerevisiae
aagctggccagtagaaaatatgcaa

SEQ ID NO: 118531 - DNA, 25 bp, S. cerevisiae
aagcgttttgctgctgtcatcatgc

SEQ ID NO: 118532 - DNA, 25 bp, S. cerevisiae
aaccccaagcgttttgctgctgtca

SEQ ID NO: 118533 - DNA, 25 bp, S. cerevisiae
aatgcagaatataaccccaagcgtt

SEQ ID NO: 118534 - DNA, 25 bp, S. cerevisiae
tacatgcccgtaatgcagaatataa

SEQ ID NO: 118535 - DNA, 25 bp, S. cerevisiae
tcatcatgcgtattagagagccaaa

SEQ ID NO: 118536 - DNA, 25 bp, S. cerevisiae
tcaaagctggccagtagaaaatatg

SEQ ID NO: 118537 - DNA, 25 bp, S. cerevisiae
gatgactcaaagctggccagtagaa

SEQ ID NO: 118538 - DNA, 25 bp, S. cerevisiae
gagagccaaaaactacagctttaat

SEQ ID NO: 118539 - DNA, 25 bp, S. cerevisiae
tcgggtttgctgctaaattcacaga

SEQ ID NO: 118540 - DNA, 25 bp, S. cerevisiae
gactcaaagctggccagtagaaaat

SEQ ID NO: 118541 - DNA, 25 bp, S. cerevisiae
ctgctaaattcacagacttcaaaat

SEQ ID NO: 118542 - DNA, 25 bp, S. cerevisiae
cagacttcaaaatacaaaatattgt

SEQ ID NO: 118543 - DNA, 25 bp, S. cerevisiae
ctgaaaacagttgcgctacatgccc

SEQ ID NO: 118544 - DNA, 25 bp, S. cerevisiae
ctgctgtcatcatgcgtattagaga

SEQ ID NO: 118545 - DNA, 25 bp, S. cerevisiae
cgctacatgcccgtaatgcagaata

SEQ ID NO: 118546 - DNA, 25 bp, S. cerevisiae
ctaaattcacagacttcaaaataca

SEQ ID NO: 118547 - DNA, 25 bp, S. cerevisiae
cccaagcgttttgctgctgtcatca

SEQ ID NO: 118548 - DNA, 25 bp, S. cerevisiae
ctgtcatcatgcgtattagagagcc

SEQ ID NO: 118549 - DNA, 25 bp, S. cerevisiae
catgcccgtaatgcagaatataacc

SEQ ID NO: 118550 - DNA, 25 bp, S. cerevisiae
cgttttgctgctgtcatcatgcgta

SEQ ID NO: 118551 - DNA, 25 bp, S. cerevisiae
gacttcaaaatacaaaatattgtcg

SEQ ID NO: 118552 - DNA, 25 bp, S. cerevisiae
gcgctacatgcccgtaatgcagaat

SEQ ID NO: 118553 - DNA, 25 bp, S. cerevisiae
gaatataaccccaagcgttttgctg

SEQ ID NO: 118554 - DNA, 25 bp, S. cerevisiae
gctgctaaattcacagacttcaaaa

SEQ ID NO: 118555 - DNA, 25 bp, S. cerevisiae
gcagaatataaccccaagcgttttg

SEQ ID NO: 118556 - DNA, 25 bp, S. cerevisiae
gctgctgtcatcatgcgtattagag

SEQ ID NO: 118557 - DNA, 25 bp, S. cerevisiae
atgcccgtaatgcagaatataaccc

SEQ ID NO: 118558 - DNA, 25 bp, S. cerevisiae
ataaccccaagcgttttgctgctgt

SEQ ID NO: 118559 - DNA, 25 bp, S. cerevisiae
atgcagaatataaccccaagcgttt

SEQ ID NO: 118560 - DNA, 25 bp, S. cerevisiae
atcgggtttgctgctaaattcacag

SEQ ID NO: 118561 - DNA, 25 bp, S. cerevisiae
atgactcaaagctggccagtagaaa

SEQ ID NO: 118562 - DNA, 25 bp, S. cerevisiae
atcatgcgtattagagagccaaaaa

SEQ ID NO: 118563 - DNA, 25 bp, S. cerevisiae
aggatgactcaaagctggccagtag

SEQ ID NO: 118564 - DNA, 25 bp, S. cerevisiae
agcgttttgctgctgtcatcatgcg

SEQ ID NO: 118565 - DNA, 25 bp, S. cerevisiae
cagttgcgctacatgcccgtaatgc

SEQ ID NO: 118566 - DNA, 25 bp, S. cerevisiae
tttccagagtgaagaggacataaaa

SEQ ID NO: 118567 - DNA, 25 bp, S. cerevisiae
tttgatccaaataccagacaagtat

SEQ ID NO: 118568 - DNA, 25 bp, S. cerevisiae
ttgttccaacactacaaaacattgt

SEQ ID NO: 118569 - DNA, 25 bp, S. cerevisiae
ttgatccaaataccagacaagtatg

SEQ ID NO: 118570 - DNA, 25 bp, S. cerevisiae
gtgtttgatccaaataccagacaag

SEQ ID NO: 118571 - DNA, 25 bp, S. cerevisiae
tgccccagaatctgaaaaagacacc

SEQ ID NO: 118572 - DNA, 25 bp, S. cerevisiae
tgtttgatccaaataccagacaagt

SEQ ID NO: 118573 - DNA, 25 bp, S. cerevisiae
gatccaaataccagacaagtatggg

SEQ ID NO: 118574 - DNA, 25 bp, S. cerevisiae
gttccaacactacaaaacattgtgg

SEQ ID NO: 118575 - DNA, 25 bp, S. cerevisiae
gtattgttccaacactacaaaacat

SEQ ID NO: 118576 - DNA, 25 bp, S. cerevisiae
actttccagagtgaagaggacataa

SEQ ID NO: 118577 - DNA, 25 bp, S. cerevisiae
aaaccagcaactactttccagagtg

SEQ ID NO: 118578 - DNA, 25 bp, S. cerevisiae
aacactacaaaacattgtggcaact

SEQ ID NO: 118579 - DNA, 25 bp, S. cerevisiae
acatcaggtattgttccaacactac

SEQ ID NO: 118580 - DNA, 25 bp, S. cerevisiae
actacaaaacattgtggcaactgtg

SEQ ID NO: 118581 - DNA, 25 bp, S. cerevisiae
acataaaaagagctgccccagaatc

SEQ ID NO: 118582 - DNA, 25 bp, S. cerevisiae
aacattgtggcaactgtgactttgg

SEQ ID NO: 118583 - DNA, 25 bp, S. cerevisiae
aaccagcaactactttccagagtga

SEQ ID NO: 118584 - DNA, 25 bp, S. cerevisiae
tccaaataccagacaagtatgggaa

SEQ ID NO: 118585 - DNA, 25 bp, S. cerevisiae
tgttccaacactacaaaacattgtg

SEQ ID NO: 118586 - DNA, 25 bp, S. cerevisiae
tccaacactacaaaacattgtggca

SEQ ID NO: 118587 - DNA, 25 bp, S. cerevisiae
tccgccacatcaggtattgttccaa

SEQ ID NO: 118588 - DNA, 25 bp, S. cerevisiae
tacaaaaccagcaactactttccag

SEQ ID NO: 118589 - DNA, 25 bp, S. cerevisiae
tgatccaaataccagacaagtatgg

SEQ ID NO: 118590 - DNA, 25 bp, S. cerevisiae
tactttccagagtgaagaggacata

SEQ ID NO: 118591 - DNA, 25 bp, S. cerevisiae
gagctgccccagaatctgaaaaaga

SEQ ID NO: 118592 - DNA, 25 bp, S. cerevisiae
ctacaaaacattgtggcaactgtga

SEQ ID NO: 118593 - DNA, 25 bp, S. cerevisiae
cactacaaaacattgtggcaactgt

SEQ ID NO: 118594 - DNA, 25 bp, S. cerevisiae
cattgtggcaactgtgactttgggg

SEQ ID NO: 118595 - DNA, 25 bp, S. cerevisiae
ccgccacatcaggtattgttccaac

SEQ ID NO: 118596 - DNA, 25 bp, S. cerevisiae
gccccagaatctgaaaaagacacct

SEQ ID NO: 118597 - DNA, 25 bp, S. cerevisiae
ccaacactacaaaacattgtggcaa

SEQ ID NO: 118598 - DNA, 25 bp, S. cerevisiae
caactactttccagagtgaagagga

SEQ ID NO: 118599 - DNA, 25 bp, S. cerevisiae
cgccacatcaggtattgttccaaca

SEQ ID NO: 118600 - DNA, 25 bp, S. cerevisiae
caacactacaaaacattgtggcaac

SEQ ID NO: 118601 - DNA, 25 bp, S. cerevisiae
gccacatcaggtattgttccaacac

SEQ ID NO: 118602 - DNA, 25 bp, S. cerevisiae
cataaaaagagctgccccagaatct

SEQ ID NO: 118603 - DNA, 25 bp, S. cerevisiae
catcaggtattgttccaacactaca

SEQ ID NO: 118604 - DNA, 25 bp, S. cerevisiae
cagcaactactttccagagtgaaga

SEQ ID NO: 118605 - DNA, 25 bp, S. cerevisiae
ctactttccagagtgaagaggacat

SEQ ID NO: 118606 - DNA, 25 bp, S. cerevisiae
cacatcaggtattgttccaacacta

SEQ ID NO: 118607 - DNA, 25 bp, S. cerevisiae
gcaactactttccagagtgaagagg

SEQ ID NO: 118608 - DNA, 25 bp, S. cerevisiae
gctgccccagaatctgaaaaagaca

SEQ ID NO: 118609 - DNA, 25 bp, S. cerevisiae
atcaggtattgttccaacactacaa

SEQ ID NO: 118610 - DNA, 25 bp, S. cerevisiae
attgttccaacactacaaaacattg

SEQ ID NO: 118611 - DNA, 25 bp, S. cerevisiae
actactttccagagtgaagaggaca

SEQ ID NO: 118612 - DNA, 25 bp, S. cerevisiae
agctgccccagaatctgaaaaagac

SEQ ID NO: 118613 - DNA, 25 bp, S. cerevisiae
agtgtttgatccaaataccagacaa

SEQ ID NO: 118614 - DNA, 25 bp, S. cerevisiae
agcaactactttccagagtgaagag

SEQ ID NO: 118615 - DNA, 25 bp, S. cerevisiae
accagcaactactttccagagtgaa

SEQ ID NO: 118616 - DNA, 25 bp, S. cerevisiae
agagctgccccagaatctgaaaaag

SEQ ID NO: 118617 - DNA, 25 bp, S. cerevisiae
taccctgtgctaagtgaatttagaa

SEQ ID NO: 118618 - DNA, 25 bp, S. cerevisiae
tttcctggtttgatctatagaatgg

SEQ ID NO: 118619 - DNA, 25 bp, S. cerevisiae
tttgaagctatataccctgtgctaa

SEQ ID NO: 118620 - DNA, 25 bp, S. cerevisiae
ttcttactggtgcaaagcaaaggga

SEQ ID NO: 118621 - DNA, 25 bp, S. cerevisiae
ttctcctcctatgagccagaattgt

SEQ ID NO: 118622 - DNA, 25 bp, S. cerevisiae
ttcagtcatggtactttctcctcct

SEQ ID NO: 118623 - DNA, 25 bp, S. cerevisiae
taccaagcttttgaagctatatacc

SEQ ID NO: 118624 - DNA, 25 bp, S. cerevisiae
tagcattcagtcatggtactttctc

SEQ ID NO: 118625 - DNA, 25 bp, S. cerevisiae
ttactggtgcaaagcaaagggaaga

SEQ ID NO: 118626 - DNA, 25 bp, S. cerevisiae
tataccctgtgctaagtgaatttag

SEQ ID NO: 118627 - DNA, 25 bp, S. cerevisiae
tttaccaagcttttgaagctatata

SEQ ID NO: 118628 - DNA, 25 bp, S. cerevisiae
ttagcattcagtcatggtactttct

SEQ ID NO: 118629 - DNA, 25 bp, S. cerevisiae
ttgttcttactggtgcaaagcaaag

SEQ ID NO: 118630 - DNA, 25 bp, S. cerevisiae
ttgtttcctggtttgatctatagaa

SEQ ID NO: 118631 - DNA, 25 bp, S. cerevisiae
ttgaagctatataccctgtgctaag

SEQ ID NO: 118632 - DNA, 25 bp, S. cerevisiae
gtcatggtactttctcctcctatga

SEQ ID NO: 118633 - DNA, 25 bp, S. cerevisiae
gtactttctcctcctatgagccaga

SEQ ID NO: 118634 - DNA, 25 bp, S. cerevisiae
ggtactttctcctcctatgagccag

SEQ ID NO: 118635 - DNA, 25 bp, S. cerevisiae
ggaaagattgttcttactggtgcaa

SEQ ID NO: 118636 - DNA, 25 bp, S. cerevisiae
tgtttcctggtttgatctatagaat

SEQ ID NO: 118637 - DNA, 25 bp, S. cerevisiae
ggttagcattcagtcatggtacttt

SEQ ID NO: 118638 - DNA, 25 bp, S. cerevisiae
gttcttactggtgcaaagcaaaggg

SEQ ID NO: 118639 - DNA, 25 bp, S. cerevisiae
aagctatataccctgtgctaagtga

SEQ ID NO: 118640 - DNA, 25 bp, S. cerevisiae
aagattgttcttactggtgcaaagc

SEQ ID NO: 118641 - DNA, 25 bp, S. cerevisiae
tcagtcatggtactttctcctccta

SEQ ID NO: 118642 - DNA, 25 bp, S. cerevisiae
tctcctcctatgagccagaattgtt

SEQ ID NO: 118643 - DNA, 25 bp, S. cerevisiae
tcctatgagccagaattgtttcctg

SEQ ID NO: 118644 - DNA, 25 bp, S. cerevisiae
tacgtctagaagggttagcattcag

SEQ ID NO: 118645 - DNA, 25 bp, S. cerevisiae
tcctcctatgagccagaattgtttc

SEQ ID NO: 118646 - DNA, 25 bp, S. cerevisiae
gaagctatataccctgtgctaagtg

SEQ ID NO: 118647 - DNA, 25 bp, S. cerevisiae
gaaagattgttcttactggtgcaaa

SEQ ID NO: 118648 - DNA, 25 bp, S. cerevisiae
gagccagaattgtttcctggtttga

SEQ ID NO: 118649 - DNA, 25 bp, S. cerevisiae
cttactggtgcaaagcaaagggaag

SEQ ID NO: 118650 - DNA, 25 bp, S. cerevisiae
ccagaattgtttcctggtttgatct

SEQ ID NO: 118651 - DNA, 25 bp, S. cerevisiae
cctatgagccagaattgtttcctgg

SEQ ID NO: 118652 - DNA, 25 bp, S. cerevisiae
cagaattgtttcctggtttgatcta

SEQ ID NO: 118653 - DNA, 25 bp, S. cerevisiae
aattgtttcctggtttgatctatag

SEQ ID NO: 118654 - DNA, 25 bp, S. cerevisiae
cctatacgtctagaagggttagcat

SEQ ID NO: 118655 - DNA, 25 bp, S. cerevisiae
ctttctcctcctatgagccagaatt

SEQ ID NO: 118656 - DNA, 25 bp, S. cerevisiae
ctatataccctgtgctaagtgaatt

SEQ ID NO: 118657 - DNA, 25 bp, S. cerevisiae
cttttgaagctatataccctgtgct

SEQ ID NO: 118658 - DNA, 25 bp, S. cerevisiae
catggtactttctcctcctatgagc

SEQ ID NO: 118659 - DNA, 25 bp, S. cerevisiae
gcattcagtcatggtactttctcct

SEQ ID NO: 118660 - DNA, 25 bp, S. cerevisiae
gctatataccctgtgctaagtgaat

SEQ ID NO: 118661 - DNA, 25 bp, S. cerevisiae
attgttcttactggtgcaaagcaaa

SEQ ID NO: 118662 - DNA, 25 bp, S. cerevisiae
atacgtctagaagggttagcattca

SEQ ID NO: 118663 - DNA, 25 bp, S. cerevisiae
atataccctgtgctaagtgaattta

SEQ ID NO: 118664 - DNA, 25 bp, S. cerevisiae
atggtactttctcctcctatgagcc

SEQ ID NO: 118665 - DNA, 25 bp, S. cerevisiae
agccagaattgtttcctggtttgat

SEQ ID NO: 118666 - DNA, 25 bp, S. cerevisiae
agtcatggtactttctcctcctatg

SEQ ID NO: 118667 - DNA, 25 bp, S. cerevisiae
tacgaagactctggatctacctata

SEQ ID NO: 118668 - DNA, 25 bp, S. cerevisiae
taccccacagtagttcagtgttcaa

SEQ ID NO: 118669 - DNA, 25 bp, S. cerevisiae
ttcgtacattcagtaaagaaattct

SEQ ID NO: 118670 - DNA, 25 bp, S. cerevisiae
ttacagaacgaacatgactattgga

SEQ ID NO: 118671 - DNA, 25 bp, S. cerevisiae
tatggttacgaagactctggatcta

SEQ ID NO: 118672 - DNA, 25 bp, S. cerevisiae
ttggatttgataccccacagtagtt

SEQ ID NO: 118673 - DNA, 25 bp, S. cerevisiae
gtggtcaaaagctgttggcaattaa

SEQ ID NO: 118674 - DNA, 25 bp, S. cerevisiae
gtagttcagtgttcaaaggcactga

SEQ ID NO: 118675 - DNA, 25 bp, S. cerevisiae
gtattagcaacaaggatgttatttt

SEQ ID NO: 118676 - DNA, 25 bp, S. cerevisiae
gtgttcaaaggcactgatttcgtac

SEQ ID NO: 118677 - DNA, 25 bp, S. cerevisiae
ggatctacctataagcatgacagag

SEQ ID NO: 118678 - DNA, 25 bp, S. cerevisiae
tgttcaaaggcactgatttcgtaca

SEQ ID NO: 118679 - DNA, 25 bp, S. cerevisiae
ggttacgaagactctggatctacct

SEQ ID NO: 118680 - DNA, 25 bp, S. cerevisiae
tgataccccacagtagttcagtgtt

SEQ ID NO: 118681 - DNA, 25 bp, S. cerevisiae
gatctacctataagcatgacagagg

SEQ ID NO: 118682 - DNA, 25 bp, S. cerevisiae
gttcagtgttcaaaggcactgattt

SEQ ID NO: 118683 - DNA, 25 bp, S. cerevisiae
gatttgataccccacagtagttcag

SEQ ID NO: 118684 - DNA, 25 bp, S. cerevisiae
gttccatattacagaacgaacatga

SEQ ID NO: 118685 - DNA, 25 bp, S. cerevisiae
aaaggcactgatttcgtacattcag

SEQ ID NO: 118686 - DNA, 25 bp, S. cerevisiae
actctggatctacctataagcatga

SEQ ID NO: 118687 - DNA, 25 bp, S. cerevisiae
actgatttcgtacattcagtaaaga

SEQ ID NO: 118688 - DNA, 25 bp, S. cerevisiae
aacgaacatgactattggaataaga

SEQ ID NO: 118689 - DNA, 25 bp, S. cerevisiae
aaggcactgatttcgtacattcagt

SEQ ID NO: 118690 - DNA, 25 bp, S. cerevisiae
aagactctggatctacctataagca

SEQ ID NO: 118691 - DNA, 25 bp, S. cerevisiae
tctggatctacctataagcatgaca

SEQ ID NO: 118692 - DNA, 25 bp, S. cerevisiae
tctacctataagcatgacagaggta

SEQ ID NO: 118693 - DNA, 25 bp, S. cerevisiae
ttcaaaggcactgatttcgtacatt

SEQ ID NO: 118694 - DNA, 25 bp, S. cerevisiae
tccatattacagaacgaacatgact

SEQ ID NO: 118695 - DNA, 25 bp, S. cerevisiae
tcagtgttcaaaggcactgatttcg

SEQ ID NO: 118696 - DNA, 25 bp, S. cerevisiae
cacagtagttcagtgttcaaaggca

SEQ ID NO: 118697 - DNA, 25 bp, S. cerevisiae
ctagtggtcaaaagctgttggcaat

SEQ ID NO: 118698 - DNA, 25 bp, S. cerevisiae
ctggatctacctataagcatgacag

SEQ ID NO: 118699 - DNA, 25 bp, S. cerevisiae
ctgatttcgtacattcagtaaagaa

SEQ ID NO: 118700 - DNA, 25 bp, S. cerevisiae
cagtgttcaaaggcactgatttcgt

SEQ ID NO: 118701 - DNA, 25 bp, S. cerevisiae
ccccacagtagttcagtgttcaaag

SEQ ID NO: 118702 - DNA, 25 bp, S. cerevisiae
ccatattacagaacgaacatgacta

SEQ ID NO: 118703 - DNA, 25 bp, S. cerevisiae
cccacagtagttcagtgttcaaagg

SEQ ID NO: 118704 - DNA, 25 bp, S. cerevisiae
cctataagcatgacagaggtattgc

SEQ ID NO: 118705 - DNA, 25 bp, S. cerevisiae
gcactgatttcgtacattcagtaaa

SEQ ID NO: 118706 - DNA, 25 bp, S. cerevisiae
gttacgaagactctggatctaccta

SEQ ID NO: 118707 - DNA, 25 bp, S. cerevisiae
gaagactctggatctacctataagc

SEQ ID NO: 118708 - DNA, 25 bp, S. cerevisiae
ataccccacagtagttcagtgttca

SEQ ID NO: 118709 - DNA, 25 bp, S. cerevisiae
atttgataccccacagtagttcagt

SEQ ID NO: 118710 - DNA, 25 bp, S. cerevisiae
atattacagaacgaacatgactatt

SEQ ID NO: 118711 - DNA, 25 bp, S. cerevisiae
atttggatttgataccccacagtag

SEQ ID NO: 118712 - DNA, 25 bp, S. cerevisiae
atatagaatcacaaaatttggattt

SEQ ID NO: 118713 - DNA, 25 bp, S. cerevisiae
acctataagcatgacagaggtattg

SEQ ID NO: 118714 - DNA, 25 bp, S. cerevisiae
agtagttcagtgttcaaaggcactg

SEQ ID NO: 118715 - DNA, 25 bp, S. cerevisiae
agaacgaacatgactattggaataa

SEQ ID NO: 118716 - DNA, 25 bp, S. cerevisiae
atggttacgaagactctggatctac

SEQ ID NO: 118717 - DNA, 25 bp, S. cerevisiae
tagccttcattcaccaacgtctgat

SEQ ID NO: 118718 - DNA, 25 bp, S. cerevisiae
tagtattcgactagaaggtgatgag

SEQ ID NO: 118719 - DNA, 25 bp, S. cerevisiae
tacattggcactaagttctaatcca

SEQ ID NO: 118720 - DNA, 25 bp, S. cerevisiae
ttctctagtcagtaatccacacgaa

SEQ ID NO: 118721 - DNA, 25 bp, S. cerevisiae
ttggcactaagttctaatccaaact

SEQ ID NO: 118722 - DNA, 25 bp, S. cerevisiae
gtattcgactagaaggtgatgagtt

SEQ ID NO: 118723 - DNA, 25 bp, S. cerevisiae
ggcactaagttctaatccaaactct

SEQ ID NO: 118724 - DNA, 25 bp, S. cerevisiae
tgaacccgtacctgaatctgcagga

SEQ ID NO: 118725 - DNA, 25 bp, S. cerevisiae
gattctctagtcagtaatccacacg

SEQ ID NO: 118726 - DNA, 25 bp, S. cerevisiae
gttctaatccaaactctagccttca

SEQ ID NO: 118727 - DNA, 25 bp, S. cerevisiae
gatgaacccgtacctgaatctgcag

SEQ ID NO: 118728 - DNA, 25 bp, S. cerevisiae
aaactctagccttcattcaccaacg

SEQ ID NO: 118729 - DNA, 25 bp, S. cerevisiae
acgaaatttatggctccatgccgtt

SEQ ID NO: 118730 - DNA, 25 bp, S. cerevisiae
acgtctgatgaacccgtacctgaat

SEQ ID NO: 118731 - DNA, 25 bp, S. cerevisiae
aagattctctagtcagtaatccaca

SEQ ID NO: 118732 - DNA, 25 bp, S. cerevisiae
aatttatggctccatgccgttggag

SEQ ID NO: 118733 - DNA, 25 bp, S. cerevisiae
tcaaatcacttaagttccgaaactg

SEQ ID NO: 118734 - DNA, 25 bp, S. cerevisiae
tacctgaatctgcaggaaaagcaga

SEQ ID NO: 118735 - DNA, 25 bp, S. cerevisiae
tcagtaatccacacgaaatttatgg

SEQ ID NO: 118736 - DNA, 25 bp, S. cerevisiae
tgaatctgcaggaaaagcagatact

SEQ ID NO: 118737 - DNA, 25 bp, S. cerevisiae
tcaccaacgtctgatgaacccgtac

SEQ ID NO: 118738 - DNA, 25 bp, S. cerevisiae
tctaatccaaactctagccttcatt

SEQ ID NO: 118739 - DNA, 25 bp, S. cerevisiae
tcattcaccaacgtctgatgaaccc

SEQ ID NO: 118740 - DNA, 25 bp, S. cerevisiae
taatccacacgaaatttatggctcc

SEQ ID NO: 118741 - DNA, 25 bp, S. cerevisiae
taattacattggcactaagttctaa

SEQ ID NO: 118742 - DNA, 25 bp, S. cerevisiae
gaaatttatggctccatgccgttgg

SEQ ID NO: 118743 - DNA, 25 bp, S. cerevisiae
cctgaatctgcaggaaaagcagata

SEQ ID NO: 118744 - DNA, 25 bp, S. cerevisiae
cattggcactaagttctaatccaaa

SEQ ID NO: 118745 - DNA, 25 bp, S. cerevisiae
gccttcattcaccaacgtctgatga

SEQ ID NO: 118746 - DNA, 25 bp, S. cerevisiae
cttaattacattggcactaagttct

SEQ ID NO: 118747 - DNA, 25 bp, S. cerevisiae
caacgtctgatgaacccgtacctga

SEQ ID NO: 118748 - DNA, 25 bp, S. cerevisiae
cgaacttaattacattggcactaag

SEQ ID NO: 118749 - DNA, 25 bp, S. cerevisiae
cgtacctgaatctgcaggaaaagca

SEQ ID NO: 118750 - DNA, 25 bp, S. cerevisiae
ccgaaactggcattaaattggcatt

SEQ ID NO: 118751 - DNA, 25 bp, S. cerevisiae
gcattggacccgaacttaattacat

SEQ ID NO: 118752 - DNA, 25 bp, S. cerevisiae
ctctagtcagtaatccacacgaaat

SEQ ID NO: 118753 - DNA, 25 bp, S. cerevisiae
cttcattcaccaacgtctgatgaac

SEQ ID NO: 118754 - DNA, 25 bp, S. cerevisiae
ctgatgaacccgtacctgaatctgc

SEQ ID NO: 118755 - DNA, 25 bp, S. cerevisiae
ccaaactctagccttcattcaccaa

SEQ ID NO: 118756 - DNA, 25 bp, S. cerevisiae
ccacacgaaatttatggctccatgc

SEQ ID NO: 118757 - DNA, 25 bp, S. cerevisiae
gaagatccagattcaaatcacttaa

SEQ ID NO: 118758 - DNA, 25 bp, S. cerevisiae
atccaaactctagccttcattcacc

SEQ ID NO: 118759 - DNA, 25 bp, S. cerevisiae
atttatggctccatgccgttggagc

SEQ ID NO: 118760 - DNA, 25 bp, S. cerevisiae
atccagattcaaatcacttaagttc

SEQ ID NO: 118761 - DNA, 25 bp, S. cerevisiae
atactagtattcgactagaaggtga

SEQ ID NO: 118762 - DNA, 25 bp, S. cerevisiae
attcgactagaaggtgatgagttag

SEQ ID NO: 118763 - DNA, 25 bp, S. cerevisiae
agatccagattcaaatcacttaagt

SEQ ID NO: 118764 - DNA, 25 bp, S. cerevisiae
agtcagtaatccacacgaaatttat

SEQ ID NO: 118765 - DNA, 25 bp, S. cerevisiae
actctagccttcattcaccaacgtc

SEQ ID NO: 118766 - DNA, 25 bp, S. cerevisiae
agtaatccacacgaaatttatggct

SEQ ID NO: 118767 - DNA, 25 bp, S. cerevisiae
agatactagtattcgactagaaggt

SEQ ID NO: 118768 - DNA, 25 bp, S. cerevisiae
tacggaagccaacgcagtgtccttt

SEQ ID NO: 118769 - DNA, 25 bp, S. cerevisiae
tttaatgctcgaaagtcctaactat

SEQ ID NO: 118770 - DNA, 25 bp, S. cerevisiae
tattgaatatacctagacgtgaact

SEQ ID NO: 118771 - DNA, 25 bp, S. cerevisiae
taccattaactgagcacaaaagccc

SEQ ID NO: 118772 - DNA, 25 bp, S. cerevisiae
tttgacacaacattttctgatttta

SEQ ID NO: 118773 - DNA, 25 bp, S. cerevisiae
tttcagctggtacggaagccaacgc

SEQ ID NO: 118774 - DNA, 25 bp, S. cerevisiae
ttcacatcaagttttcagctggtac

SEQ ID NO: 118775 - DNA, 25 bp, S. cerevisiae
ttgtaacgcactcattcacatcaag

SEQ ID NO: 118776 - DNA, 25 bp, S. cerevisiae
gtcctaactattgtaacgcactcat

SEQ ID NO: 118777 - DNA, 25 bp, S. cerevisiae
gtaacgcactcattcacatcaagtt

SEQ ID NO: 118778 - DNA, 25 bp, S. cerevisiae
gtagaggacttcctacattttattg

SEQ ID NO: 118779 - DNA, 25 bp, S. cerevisiae
gtcctttgacacaacattttctgat

SEQ ID NO: 118780 - DNA, 25 bp, S. cerevisiae
gtgtcctttgacacaacattttctg

SEQ ID NO: 118781 - DNA, 25 bp, S. cerevisiae
ggtacggaagccaacgcagtgtcct

SEQ ID NO: 118782 - DNA, 25 bp, S. cerevisiae
tgagcacaaaagccctaatctaagt

SEQ ID NO: 118783 - DNA, 25 bp, S. cerevisiae
gatccgtgccttcgataaactattg

SEQ ID NO: 118784 - DNA, 25 bp, S. cerevisiae
actgagcacaaaagccctaatctaa

SEQ ID NO: 118785 - DNA, 25 bp, S. cerevisiae
aaactattgaatatacctagacgtg

SEQ ID NO: 118786 - DNA, 25 bp, S. cerevisiae
actattgtaacgcactcattcacat

SEQ ID NO: 118787 - DNA, 25 bp, S. cerevisiae
aagagatccgtgccttcgataaact

SEQ ID NO: 118788 - DNA, 25 bp, S. cerevisiae
aacgcactcattcacatcaagtttt

SEQ ID NO: 118789 - DNA, 25 bp, S. cerevisiae
aacgcagtgtcctttgacacaacat

SEQ ID NO: 118790 - DNA, 25 bp, S. cerevisiae
taaagagatccgtgccttcgataaa

SEQ ID NO: 118791 - DNA, 25 bp, S. cerevisiae
tcaagttttcagctggtacggaagc

SEQ ID NO: 118792 - DNA, 25 bp, S. cerevisiae
tgccttcgataaactattgaatata

SEQ ID NO: 118793 - DNA, 25 bp, S. cerevisiae
tctaagtttaatgctcgaaagtcct

SEQ ID NO: 118794 - DNA, 25 bp, S. cerevisiae
tctaccattaactgagcacaaaagc

SEQ ID NO: 118795 - DNA, 25 bp, S. cerevisiae
taactattgtaacgcactcattcac

SEQ ID NO: 118796 - DNA, 25 bp, S. cerevisiae
taaatctaccattaactgagcacaa

SEQ ID NO: 118797 - DNA, 25 bp, S. cerevisiae
tgacacaacattttctgattttaaa

SEQ ID NO: 118798 - DNA, 25 bp, S. cerevisiae
gagatccgtgccttcgataaactat

SEQ ID NO: 118799 - DNA, 25 bp, S. cerevisiae
gaagccaacgcagtgtcctttgaca

SEQ ID NO: 118800 - DNA, 25 bp, S. cerevisiae
ctcattcacatcaagttttcagctg

SEQ ID NO: 118801 - DNA, 25 bp, S. cerevisiae
cagtgtcctttgacacaacattttc

SEQ ID NO: 118802 - DNA, 25 bp, S. cerevisiae
cctaactattgtaacgcactcattc

SEQ ID NO: 118803 - DNA, 25 bp, S. cerevisiae
cacatcaagttttcagctggtacgg

SEQ ID NO: 118804 - DNA, 25 bp, S. cerevisiae
ccaacgcagtgtcctttgacacaac

SEQ ID NO: 118805 - DNA, 25 bp, S. cerevisiae
cctttgacacaacattttctgattt

SEQ ID NO: 118806 - DNA, 25 bp, S. cerevisiae
cattcacatcaagttttcagctggt

SEQ ID NO: 118807 - DNA, 25 bp, S. cerevisiae
ctggtacggaagccaacgcagtgtc

SEQ ID NO: 118808 - DNA, 25 bp, S. cerevisiae
cgcactcattcacatcaagttttca

SEQ ID NO: 118809 - DNA, 25 bp, S. cerevisiae
cgtgccttcgataaactattgaata

SEQ ID NO: 118810 - DNA, 25 bp, S. cerevisiae
gaatatacctagacgtgaactcaaa

SEQ ID NO: 118811 - DNA, 25 bp, S. cerevisiae
ccattaactgagcacaaaagcccta

SEQ ID NO: 118812 - DNA, 25 bp, S. cerevisiae
attaactgagcacaaaagccctaat

SEQ ID NO: 118813 - DNA, 25 bp, S. cerevisiae
atatacctagacgtgaactcaaaat

SEQ ID NO: 118814 - DNA, 25 bp, S. cerevisiae
atgctcgaaagtcctaactattgta

SEQ ID NO: 118815 - DNA, 25 bp, S. cerevisiae
agctggtacggaagccaacgcagtg

SEQ ID NO: 118816 - DNA, 25 bp, S. cerevisiae
agccaacgcagtgtcctttgacaca

SEQ ID NO: 118817 - DNA, 25 bp, S. cerevisiae
agccctaatctaagtttaatgctcg

SEQ ID NO: 118818 - DNA, 25 bp, Bacillus subtillis
tttacaggtgcagtcaccgaaagag

SEQ ID NO: 118819 - DNA, 25 bp, Bacillus subtillis
ttttgtgcctgtgcagattgcaata

SEQ ID NO: 118820 - DNA, 25 bp, Bacillus subtillis
ttagagacgattacaagcggaggcg

SEQ ID NO: 118821 - DNA, 25 bp, Bacillus subtillis
tttcacaaatggcagacttgaagat

SEQ ID NO: 118822 - DNA, 25 bp, Bacillus subtillis
ttaaagaggattttgtgcctgtgca

SEQ ID NO: 118823 - DNA, 25 bp, Bacillus subtillis
gattacaagcggaggcgctgccgcg

SEQ ID NO: 118824 - DNA, 25 bp, Bacillus subtillis
gatttcggtttcacaaatggcagac

SEQ ID NO: 118825 - DNA, 25 bp, Bacillus subtillis
aagagagcgcctatctcattcagaa

SEQ ID NO: 118826 - DNA, 25 bp, Bacillus subtillis
gaggcgctggcaagcccgaatcggt

SEQ ID NO: 118827 - DNA, 25 bp, Bacillus subtillis
gagcagcctttcgagaaacgttcat

SEQ ID NO: 118828 - DNA, 25 bp, Bacillus subtillis
gagcgcctatctcattcagaatatt

SEQ ID NO: 118829 - DNA, 25 bp, Bacillus subtillis
ccgcgcagcttgaacgactaaagca

SEQ ID NO: 118830 - DNA, 25 bp, Bacillus subtillis
caccgaaagagagcgcctatctcat

SEQ ID NO: 118831 - DNA, 25 bp, Bacillus subtillis
gcagcttgaacgactaaagcagaaa

SEQ ID NO: 118832 - DNA, 25 bp, Bacillus subtillis
gcagcagttccgctttatctattac

SEQ ID NO: 118833 - DNA, 25 bp, Bacillus subtillis
gcagattgcaatagactatgaggct

SEQ ID NO: 118834 - DNA, 25 bp, Bacillus subtillis
gcttttaatgcgggagctgcgattt

SEQ ID NO: 118835 - DNA, 25 bp, Bacillus subtillis
actatgaggctgcgaaggcagatgc

SEQ ID NO: 118836 - DNA, 25 bp, Bacillus subtillis
atagactatgaggctgcgaaggcag

SEQ ID NO: 118837 - DNA, 25 bp, Bacillus subtillis
agacgattacaagcggaggcgctgc

SEQ ID NO: 118838 - DNA, 25 bp, Bacillus subtillis
tatctcaacggcctcggcaattgtt

SEQ ID NO: 118839 - DNA, 25 bp, Bacillus subtillis
tggacttcctgatattgttgataca

SEQ ID NO: 118840 - DNA, 25 bp, Bacillus subtillis
gttgcctcggcagctggtgcgaaaa

SEQ ID NO: 118841 - DNA, 25 bp, Bacillus subtillis
gattcgcacgatgagtgtaaagaac

SEQ ID NO: 118842 - DNA, 25 bp, Bacillus subtillis
tactgccggtgaggctgaaacgctg

SEQ ID NO: 118843 - DNA, 25 bp, Bacillus subtillis
gttttgtgaaggcaatgcgggcaca

SEQ ID NO: 118844 - DNA, 25 bp, Bacillus subtillis
gatattgtcaattcttgctcatcgg

SEQ ID NO: 118845 - DNA, 25 bp, Bacillus subtillis
acacgctcttacagtcgatggactt

SEQ ID NO: 118846 - DNA, 25 bp, Bacillus subtillis
aagccggtgcgctgctgaaaacgat

SEQ ID NO: 118847 - DNA, 25 bp, Bacillus subtillis
tacaggcaggtgctggcattgttgc

SEQ ID NO: 118848 - DNA, 25 bp, Bacillus subtillis
tatgatgatggcagcggaaatgact

SEQ ID NO: 118849 - DNA, 25 bp, Bacillus subtillis
gaaaacgattcatattgcagaagac

SEQ ID NO: 118850 - DNA, 25 bp, Bacillus subtillis
cgctaagcatggcaatcgctctgtc

SEQ ID NO: 118851 - DNA, 25 bp, Bacillus subtillis
caatgcgggcacacgctcttacagt

SEQ ID NO: 118852 - DNA, 25 bp, Bacillus subtillis
ctcggcaattgttgcctcggcagct

SEQ ID NO: 118853 - DNA, 25 bp, Bacillus subtillis
cttgtattacgattcgcacgatgag

SEQ ID NO: 118854 - DNA, 25 bp, Bacillus subtillis
ctgatgaacagatttctacaattgt

SEQ ID NO: 118855 - DNA, 25 bp, Bacillus subtillis
caatcgctctgtctcttctaaaagc

SEQ ID NO: 118856 - DNA, 25 bp, Bacillus subtillis
cggtgttgcatcgatacaggcaggt

SEQ ID NO: 118857 - DNA, 25 bp, Bacillus subtillis
cattgttgctgattctgttccggaa

SEQ ID NO: 118858 - DNA, 25 bp, Bacillus subtillis
tttgcagcttgcggcggaatcacag

SEQ ID NO: 118859 - DNA, 25 bp, Bacillus subtillis
ttcagcttcacggtgatgaaaaacc

SEQ ID NO: 118860 - DNA, 25 bp, Bacillus subtillis
ttaacatttgtcaatgaacatgggg

SEQ ID NO: 118861 - DNA, 25 bp, Bacillus subtillis
ttgattcatctgtaaaagggtctag

SEQ ID NO: 118862 - DNA, 25 bp, Bacillus subtillis
gtcactaaaggatttgcagcttgcg

SEQ ID NO: 118863 - DNA, 25 bp, Bacillus subtillis
gtattgccaagagcttgaagctcga

SEQ ID NO: 118864 - DNA, 25 bp, Bacillus subtillis
ggatgctgctgctcttcgcaagctg

SEQ ID NO: 118865 - DNA, 25 bp, Bacillus subtillis
tgggaatgtgtgccggaatatcagc

SEQ ID NO: 118866 - DNA, 25 bp, Bacillus subtillis
acgatgtcacgtattgccaagagct

SEQ ID NO: 118867 - DNA, 25 bp, Bacillus subtillis
tgccggaatatcagcaggcggctat

SEQ ID NO: 118868 - DNA, 25 bp, Bacillus subtillis
tctcagcgtaaagcaatccatgctt

SEQ ID NO: 118869 - DNA, 25 bp, Bacillus subtillis
gagcttgaagctcgacgtcattcag

SEQ ID NO: 118870 - DNA, 25 bp, Bacillus subtillis
gcgagctgtacttatcggtgaatca

SEQ ID NO: 118871 - DNA, 25 bp, Bacillus subtillis
gcgcttcaccatcaagataacacaa

SEQ ID NO: 118872 - DNA, 25 bp, Bacillus subtillis
gcggcggaatcacaggctgattacc

SEQ ID NO: 118873 - DNA, 25 bp, Bacillus subtillis
ctcgacgtcattcagcttcacggtg

SEQ ID NO: 118874 - DNA, 25 bp, Bacillus subtillis
atcaatagagacgatgtcacgtatt

SEQ ID NO: 118875 - DNA, 25 bp, Bacillus subtillis
atgagacaaacttctcagcgtaaag

SEQ ID NO: 118876 - DNA, 25 bp, Bacillus subtillis
atgttgacggctttgtgattgattc

SEQ ID NO: 118877 - DNA, 25 bp, Bacillus subtillis
agctgacaggctgtgaaatatggaa

SEQ ID NO: 118878 - DNA, 25 bp, Bacillus subtillis
tatcagctgatcgcccgtgtagaag

SEQ ID NO: 118879 - DNA, 25 bp, Bacillus subtillis
gtaaaggcagccgaggaatccaatg

SEQ ID NO: 118880 - DNA, 25 bp, Bacillus subtillis
acgaagccgacatgctgttctctgt

SEQ ID NO: 118881 - DNA, 25 bp, Bacillus subtillis
aagatccgaacacagcggtcgacat

SEQ ID NO: 118882 - DNA, 25 bp, Bacillus subtillis
actgatgatgaaatccttcacgcat

SEQ ID NO: 118883 - DNA, 25 bp, Bacillus subtillis
aaggcagcaaggtcgtagctgtgtt

SEQ ID NO: 118884 - DNA, 25 bp, Bacillus subtillis
tgcgcgtctatcgcaggagtgctga

SEQ ID NO: 118885 - DNA, 25 bp, Bacillus subtillis
tcggaatggcgctcagcagatattt

SEQ ID NO: 118886 - DNA, 25 bp, Bacillus subtillis
tcagaaatcaagcctgtcacattgc

SEQ ID NO: 118887 - DNA, 25 bp, Bacillus subtillis
tgctgttctctgtcactgttcccgg

SEQ ID NO: 118888 - DNA, 25 bp, Bacillus subtillis
tgaccgtctttgaaagcgacaaatg

SEQ ID NO: 118889 - DNA, 25 bp, Bacillus subtillis
gacagcatccttgaatatgtaaaag

SEQ ID NO: 118890 - DNA, 25 bp, Bacillus subtillis
cctgtcacattgccgactgatgaag

SEQ ID NO: 118891 - DNA, 25 bp, Bacillus subtillis
cagataacctgatctaccaagtggc

SEQ ID NO: 118892 - DNA, 25 bp, Bacillus subtillis
cagaaccaggttcttgcgcgtctat

SEQ ID NO: 118893 - DNA, 25 bp, Bacillus subtillis
ctcctgtccatgtgaaggtgtggag

SEQ ID NO: 118894 - DNA, 25 bp, Bacillus subtillis
cagatatttgaagctgaccgtcttt

SEQ ID NO: 118895 - DNA, 25 bp, Bacillus subtillis
gcggtcgacatttcagaaatcaagc

SEQ ID NO: 118896 - DNA, 25 bp, Bacillus subtillis
gctttgattcagtcggaatggcgct

SEQ ID NO: 118897 - DNA, 25 bp, Bacillus subtillis
atccttcacgcatatcagctgatcg

SEQ ID NO: 118898 - DNA, 25 bp, Bacillus subtillis
gggatcatttaaagatcgcggaatg

SEQ ID NO: 118899 - DNA, 25 bp, Bacillus subtillis
gtccgttccatctgtgagaaatcac

SEQ ID NO: 118900 - DNA, 25 bp, Bacillus subtillis
ggaaaactcgctcaagctgtcatgt

SEQ ID NO: 118901 - DNA, 25 bp, Bacillus subtillis
tgtgagaaatcaccgattgcccttg

SEQ ID NO: 118902 - DNA, 25 bp, Bacillus subtillis
acacgattatgtgcgcgtcaacagg

SEQ ID NO: 118903 - DNA, 25 bp, Bacillus subtillis
acacctcttattcacctgccgaagc

SEQ ID NO: 118904 - DNA, 25 bp, Bacillus subtillis
tcagtcaacccttaccgcattgaag

SEQ ID NO: 118905 - DNA, 25 bp, Bacillus subtillis
tgcattgtcatcatcccgaacggaa

SEQ ID NO: 118906 - DNA, 25 bp, Bacillus subtillis
ctgctgccttcgaagtgtgcgaaca

SEQ ID NO: 118907 - DNA, 25 bp, Bacillus subtillis
catgagaaaaacggcacaggccttc

SEQ ID NO: 118908 - DNA, 25 bp, Bacillus subtillis
cagcccgtgctaacatgaaatgcat

SEQ ID NO: 118909 - DNA, 25 bp, Bacillus subtillis
ctgtaacagatcaaacaccggcgct

SEQ ID NO: 118910 - DNA, 25 bp, Bacillus subtillis
gcgtcaacaggtaacacttccgctg

SEQ ID NO: 118911 - DNA, 25 bp, Bacillus subtillis
cggcagcatatgcagcccgtgctaa

SEQ ID NO: 118912 - DNA, 25 bp, Bacillus subtillis
cacttccgctgctgcggcagcatat

SEQ ID NO: 118913 - DNA, 25 bp, Bacillus subtillis
gcaatcgtgcgcaatgaagtgattg

SEQ ID NO: 118914 - DNA, 25 bp, Bacillus subtillis
gcggcggcaatcgtgcgcaatgaag

SEQ ID NO: 118915 - DNA, 25 bp, Bacillus subtillis
gaaggcaatgacacgattatgtgcg

SEQ ID NO: 118916 - DNA, 25 bp, Bacillus subtillis
gaattgagcttcatgtcaaaacgga

SEQ ID NO: 118917 - DNA, 25 bp, Bacillus subtillis
gctggaaacatcactgcgtactgga

SEQ ID NO: 118918 - DNA, 25 bp, Bacillus subtillis
gtaccgggcgatgcttgtgcctgag

SEQ ID NO: 118919 - DNA, 25 bp, Bacillus subtillis
tgtcattcctttttatgaagtgctg

SEQ ID NO: 118920 - DNA, 25 bp, Bacillus subtillis
gttccatcagccgtaccgggcgatg

SEQ ID NO: 118921 - DNA, 25 bp, Bacillus subtillis
tgaagtgctgacaagagacgcgaga

SEQ ID NO: 118922 - DNA, 25 bp, Bacillus subtillis
tgccgatgccgtaaaagcaagtgct

SEQ ID NO: 118923 - DNA, 25 bp, Bacillus subtillis
tgctgtcagcaatatcctcattgct

SEQ ID NO: 118924 - DNA, 25 bp, Bacillus subtillis
cctcattgctgcgatcatgtccaag

SEQ ID NO: 118925 - DNA, 25 bp, Bacillus subtillis
cggcggacttgtgatcggcctgcat

SEQ ID NO: 118926 - DNA, 25 bp, Bacillus subtillis
cccgaatgctgacattgacgtagtc

SEQ ID NO: 118927 - DNA, 25 bp, Bacillus subtillis
catgtccaaggattggccgcttgtc

SEQ ID NO: 118928 - DNA, 25 bp, Bacillus subtillis
cggagcaggcccaacgattctcgtc

SEQ ID NO: 118929 - DNA, 25 bp, Bacillus subtillis
cggcctgcatgaggatgacgagacc

SEQ ID NO: 118930 - DNA, 25 bp, Bacillus subtillis
cgcttctctcgtcggcggacttgtg

SEQ ID NO: 118931 - DNA, 25 bp, Bacillus subtillis
gctcgcgcttcatttccctcattgt

SEQ ID NO: 118932 - DNA, 25 bp, Bacillus subtillis
gaaggagtttccatatgccgatgcc

SEQ ID NO: 118933 - DNA, 25 bp, Bacillus subtillis
ccaaatgatccgcgtcccgaatgct

SEQ ID NO: 118934 - DNA, 25 bp, Bacillus subtillis
atatggaacggctctcagcggagca

SEQ ID NO: 118935 - DNA, 25 bp, Bacillus subtillis
agacgcgagagacgtgcttccgaag

SEQ ID NO: 118936 - DNA, 25 bp, Bacillus subtillis
agaaggacacccggacaatgctggc

SEQ ID NO: 118937 - DNA, 25 bp, Bacillus subtillis
agtagagcacgtcgccgagatgaag

SEQ ID NO: 118938 - DNA, 25 bp, Bacillus subtillis
tttcggtttcacaaatggcagactt

SEQ ID NO: 118939 - DNA, 25 bp, Bacillus subtillis
gtgcagtcaccgaaagagagcgcct

SEQ ID NO: 118940 - DNA, 25 bp, Bacillus subtillis
gggaattaccgcctcactgaaggaa

SEQ ID NO: 118941 - DNA, 25 bp, Bacillus subtillis
ggtagagcagcctttcgagaaacgt

SEQ ID NO: 118942 - DNA, 25 bp, Bacillus subtillis
gattttgtgcctgtgcagattgcaa

SEQ ID NO: 118943 - DNA, 25 bp, Bacillus subtillis
aaacactggttttgccggtagagca

SEQ ID NO: 118944 - DNA, 25 bp, Bacillus subtillis
aagcatcgccgtcaaaagggcttat

SEQ ID NO: 118945 - DNA, 25 bp, Bacillus subtillis
tgccgcgcagcttgaacgactaaag

SEQ ID NO: 118946 - DNA, 25 bp, Bacillus subtillis
taaggaggcgctggcaagcccgaat

SEQ ID NO: 118947 - DNA, 25 bp, Bacillus subtillis
gagctgcgatttacacggcgggaat

SEQ ID NO: 118948 - DNA, 25 bp, Bacillus subtillis
gagagcgcctatctcattcagaata

SEQ ID NO: 118949 - DNA, 25 bp, Bacillus subtillis
ggcacacgctcttacagtcgatgga

SEQ ID NO: 118950 - DNA, 25 bp, Bacillus subtillis
gatattgtcaattcttgctcatcgg

SEQ ID NO: 118951 - DNA, 25 bp, Bacillus subtillis
gttgcctcggcagctggtgcgaaaa

SEQ ID NO: 118952 - DNA, 25 bp, Bacillus subtillis
aaagccggtgcgctgctgaaaacga

SEQ ID NO: 118953 - DNA, 25 bp, Bacillus subtillis
aaaacccttactgccggtgaggctg

SEQ ID NO: 118954 - DNA, 25 bp, Bacillus subtillis
aatcgctaagcatggcaatcgctct

SEQ ID NO: 118955 - DNA, 25 bp, Bacillus subtillis
tgctgattctgttccggaagccgaa

SEQ ID NO: 118956 - DNA, 25 bp, Bacillus subtillis
gagacggtatttccacttttaatat

SEQ ID NO: 118957 - DNA, 25 bp, Bacillus subtillis
cgatggacttcctgatattgttgat

SEQ ID NO: 118958 - DNA, 25 bp, Bacillus subtillis
gcaatcgctctgtctcttctaaaag

SEQ ID NO: 118959 - DNA, 25 bp, Bacillus subtillis
agaacggtgttgcatcgatacaggc

SEQ ID NO: 118960 - DNA, 25 bp, Bacillus subtillis
ggaaggcgcttcaccatcaagataa

SEQ ID NO: 118961 - DNA, 25 bp, Bacillus subtillis
ggcgcgagctgtacttatcggtgaa

SEQ ID NO: 118962 - DNA, 25 bp, Bacillus subtillis
aaaaccggcggatgctgctgctctt

SEQ ID NO: 118963 - DNA, 25 bp, Bacillus subtillis
acgatgtcacgtattgccaagagct

SEQ ID NO: 118964 - DNA, 25 bp, Bacillus subtillis
aactggtgttgcattttcttgggaa

SEQ ID NO: 118965 - DNA, 25 bp, Bacillus subtillis
aatattgcggtattcggtcactaaa

SEQ ID NO: 118966 - DNA, 25 bp, Bacillus subtillis
gagcttgaagctcgacgtcattcag

SEQ ID NO: 118967 - DNA, 25 bp, Bacillus subtillis
gacggctttgtgattgattcatctg

SEQ ID NO: 118968 - DNA, 25 bp, Bacillus subtillis
gacgtcattcagcttcacggtgatg

SEQ ID NO: 118969 - DNA, 25 bp, Bacillus subtillis
ctcttcgcaagctgacaggctgtga

SEQ ID NO: 118970 - DNA, 25 bp, Bacillus subtillis
gcttgcggcggaatcacaggctgat

SEQ ID NO: 118971 - DNA, 25 bp, P1 bacteriophage
ttatcttctatatcttcaggcgcgc

SEQ ID NO: 118972 - DNA, 25 bp, P1 bacteriophage
tatccagcaacatttgggccagcta

SEQ ID NO: 118973 - DNA, 25 bp, P1 bacteriophage
ggcgttttctgagcatacctggaaa

SEQ ID NO: 118974 - DNA, 25 bp, P1 bacteriophage
gatcgccaggcgttttctgagcata

SEQ ID NO: 118975 - DNA, 25 bp, P1 bacteriophage
aaacaggctctagcgttcgaacgca

SEQ ID NO: 118976 - DNA, 25 bp, P1 bacteriophage
aaaatgcttctgtccgtttgccggt

SEQ ID NO: 118977 - DNA, 25 bp, P1 bacteriophage
aatggtttcccgcagaacctgaaga

SEQ ID NO: 118978 - DNA, 25 bp, P1 bacteriophage
aacctgaagatgttcgcgattatct

SEQ ID NO: 118979 - DNA, 25 bp, P1 bacteriophage
tcaggcgcgcggtctggcagtaaaa

SEQ ID NO: 118980 - DNA, 25 bp, P1 bacteriophage
taaacatgcttcatcgtcggtccgg

SEQ ID NO: 118981 - DNA, 25 bp, P1 bacteriophage
acctggaaaatgcttctgtccgttt

SEQ ID NO: 118982 - DNA, 25 bp, P1 bacteriophage
tattggcagaacgaaaacgctggtt

SEQ ID NO: 118983 - DNA, 25 bp, P1 bacteriophage
ttccgtctctggtgtagctgatgat

SEQ ID NO: 118984 - DNA, 25 bp, P1 bacteriophage
ggtcgagcgatggatttccgtctct

SEQ ID NO: 118985 - DNA, 25 bp, P1 bacteriophage
gggtaactaaactggtcgagcgatg

SEQ ID NO: 118986 - DNA, 25 bp, P1 bacteriophage
ggagaatgttaatccatattggcag

SEQ ID NO: 118987 - DNA, 25 bp, P1 bacteriophage
gatatctcacgtactgacggtggga

SEQ ID NO: 118988 - DNA, 25 bp, P1 bacteriophage
aaaacgctggttagcaccgcaggtg

SEQ ID NO: 118989 - DNA, 25 bp, P1 bacteriophage
aaaaaatggtgttgccgcgccatct

SEQ ID NO: 118990 - DNA, 25 bp, P1 bacteriophage
gctgatgatccgaataactacctgt

SEQ ID NO: 118991 - DNA, 25 bp, P1 bacteriophage
atccgaataactacctgttttgccg

SEQ ID NO: 118992 - DNA, 25 bp, P1 bacteriophage
accgcaggtgtagagaaggcactta

SEQ ID NO: 118993 - DNA, 25 bp, E. coli
gttataaaccggtcgcctctggcag

SEQ ID NO: 118994 - DNA, 25 bp, E. coli
gttacagcgcaacagcagcctgcag

SEQ ID NO: 118995 - DNA, 25 bp, E. coli
aaggtttacgcaatagcgacgcgct

SEQ ID NO: 118996 - DNA, 25 bp, E. coli
aatagcgacgcgctggcgttacagc

SEQ ID NO: 118997 - DNA, 25 bp, E. coli
gagggcagaccgatagaatcattgg

SEQ ID NO: 118998 - DNA, 25 bp, E. coli
ctctggcagcgaaaagaccccggaa

SEQ ID NO: 118999 - DNA, 25 bp, E. coli
gaatcattggtaatgagcgccggat

SEQ ID NO: 119000 - DNA, 25 bp, E. coli
atcatcagcgcgcaagagggcagac

SEQ ID NO: 119001 - DNA, 25 bp, E. coli
agtaaatccttacaccttcgcagaa

SEQ ID NO: 119002 - DNA, 25 bp, E. coli
agcctgcagctggattacgcaacag

SEQ ID NO: 119003 - DNA, 25 bp, E. coli
agcaggctaccggacggcaggttat

SEQ ID NO: 119004 - DNA, 25 bp, E. coli
gggtaacacaggaacaactgccggt

SEQ ID NO: 119005 - DNA, 25 bp, E. coli
ggtaatacaacacgccggactgact

SEQ ID NO: 119006 - DNA, 25 bp, E. coli
gtagttggtgtgaaactcggctgta

SEQ ID NO: 119007 - DNA, 25 bp, E. coli
aacaactgccggtgatactggtagt

SEQ ID NO: 119008 - DNA, 25 bp, E. coli
aactcggctgtattaatcacgcgat

SEQ ID NO: 119009 - DNA, 25 bp, E. coli
tgctgggagagatcccctggcttgc

SEQ ID NO: 119010 - DNA, 25 bp, E. coli
gacactttcacttttgcagattggg

SEQ ID NO: 119011 - DNA, 25 bp, E. coli
gcctccgggaaaacgtcacgctgaa

SEQ ID NO: 119012 - DNA, 25 bp, E. coli
gcgaacgatgttacgcctccgggaa

SEQ ID NO: 119013 - DNA, 25 bp, E. coli
gctgaatatatgaccacgctcaccc

SEQ ID NO: 119014 - DNA, 25 bp, E. coli
atcacgcgatgttgactgcacaggt

SEQ ID NO: 119015 - DNA, 25 bp, E. coli
tgcggtaatttatccacggcactcc

SEQ ID NO: 119016 - DNA, 25 bp, E. coli
ggagatatcgaatccctgccgttag

SEQ ID NO: 119017 - DNA, 25 bp, E. coli
gtaaatacacccacgtactggacgc

SEQ ID NO: 119018 - DNA, 25 bp, E. coli
tgcagatctacagcgccagagtgct

SEQ ID NO: 119019 - DNA, 25 bp, E. coli
gagtgctgacgccttactggcaatg

SEQ ID NO: 119020 - DNA, 25 bp, E. coli
caatgcttgttcaggcacgccagaa

SEQ ID NO: 119021 - DNA, 25 bp, E. coli
ctggcaatgcttccacagcgtaaat

SEQ ID NO: 119022 - DNA, 25 bp, E. coli
gcaggtgacggccttagatctctcg

SEQ ID NO: 119023 - DNA, 25 bp, E. coli
gcatggagcaatctcgcagtgcagt

SEQ ID NO: 119024 - DNA, 25 bp, E. coli
gcgacgttcgatcttgcatggagca

SEQ ID NO: 119025 - DNA, 25 bp, E. coli
aggatgccgcagaccattatctggc

SEQ ID NO: 119026 - DNA, 25 bp, E. coli
tttgatgatgcgctcagtgccatgc

SEQ ID NO: 119027 - DNA, 25 bp, E. coli
gttacccgaacgtcatcaggcgtgg

SEQ ID NO: 119028 - DNA, 25 bp, E. coli
taacgcgttcgcagttgcagcgatt

SEQ ID NO: 119029 - DNA, 25 bp, E. coli
tgcagcgattgcaactggcctggcc

SEQ ID NO: 119030 - DNA, 25 bp, E. coli
gaacggcgtgcattatcaacatcat

SEQ ID NO: 119031 - DNA, 25 bp, E. coli
gcgttcgctgaaaggcatcggtgcc

SEQ ID NO: 119032 - DNA, 25 bp, E. coli
cggtgccacgcatcttcatgaaggg

SEQ ID NO: 119033 - DNA, 25 bp, E. coli
gctggtgcagggatcgttacccgaa

SEQ ID NO: 119034 - DNA, 25 bp, E. coli
atgaagggcgcgacccgcgaatatt

SEQ ID NO: 119035 - DNA, 25 bp, E. coli
atgctaatcgctttttaccgccaga

SEQ ID NO: 119036 - DNA, 25 bp, E. coli
agcccatcacgctgtggtttgatga

SEQ ID NO: 119037 - DNA, 25 bp, E. coli
ggatcaaagtctgttctggcggcat

SEQ ID NO: 119038 - DNA, 25 bp, E. coli
ggaacgcctcgatacgctggaaaaa

SEQ ID NO: 119039 - DNA, 25 bp, E. coli
aaaagtgcgcgatgccgggatcaaa

SEQ ID NO: 119040 - DNA, 25 bp, E. coli
tgagtgaatctcaggcgcagcgcct

SEQ ID NO: 119041 - DNA, 25 bp, E. coli
gagttttacggcaatatcatcacca

SEQ ID NO: 119042 - DNA, 25 bp, E. coli
gaacgccgggctggattactacaac

SEQ ID NO: 119043 - DNA, 25 bp, E. coli
gccggaaagcgtgccaatcaacatg

SEQ ID NO: 119044 - DNA, 25 bp, E. coli
attgctgcaactggcaaacctgccg

SEQ ID NO: 119045 - DNA, 25 bp, E. coli
atgacgctgggcacgttgagtgaat

SEQ ID NO: 119046 - DNA, 25 bp, E. coli
atcaccacacgcacttatcaggaac

SEQ ID NO: 119047 - DNA, 25 bp, E. coli
agatcgcgccggattattgctgcaa

SEQ ID NO: 119048 - DNA, 25 bp, E. coli
ttgaagcgcagcaggtgcatcgcca

SEQ ID NO: 119049 - DNA, 25 bp, E. coli
ttgctgtcgattaagaccggagctt

SEQ ID NO: 119050 - DNA, 25 bp, E. coli
gtcgcgctacaaaaccgggctggaa

SEQ ID NO: 119051 - DNA, 25 bp, E. coli
ggagcttgtccggaagattgcaaat

SEQ ID NO: 119052 - DNA, 25 bp, E. coli
gattgcaaatactgcccgcaaacgt

SEQ ID NO: 119053 - DNA, 25 bp, E. coli
tgcaggtcagcacgttgctgtcgat

SEQ ID NO: 119054 - DNA, 25 bp, E. coli
ccgagcggttgatggaagttgaaca

SEQ ID NO: 119055 - DNA, 25 bp, E. coli
gctggatctgctgtttgaagcgcag

SEQ ID NO: 119056 - DNA, 25 bp, E. coli
gcggcaggatcgacgcgcttctgta

SEQ ID NO: 119057 - DNA, 25 bp, E. coli
atttcgatcctcgtcaggtgcaggt

SEQ ID NO: 119058 - DNA, 25 bp, E. coli
aggtgcatcgccagcatttcgatcc

SEQ ID NO: 119059 - DNA, 25 bp, E. coli
gtgctttatggcaggcgcaaactcg

SEQ ID NO: 119060 - DNA, 25 bp, E. coli
gattttctacggttgcaaactgctg

SEQ ID NO: 119061 - DNA, 25 bp, E. coli
gttgcaaactgctgaccacgccgaa

SEQ ID NO: 119062 - DNA, 25 bp, E. coli
acaacagcaacgtcttgaacaggcg

SEQ ID NO: 119063 - DNA, 25 bp, E. coli
taaatccgcagcaaactgccgtgct

SEQ ID NO: 119064 - DNA, 25 bp, E. coli
taaagacctgcaactgttccgcaaa

SEQ ID NO: 119065 - DNA, 25 bp, E. coli
gaccacgccgaatccggaagaagat

SEQ ID NO: 119066 - DNA, 25 bp, E. coli
gactcaggcgatgtgctttatggca

SEQ ID NO: 119067 - DNA, 25 bp, E. coli
ctttctgccggacgcgagcagatga

SEQ ID NO: 119068 - DNA, 25 bp, E. coli
aggcgcaaactcgattttctacggt

SEQ ID NO: 119069 - DNA, 25 bp, E. coli
agatgaacgaacagactcaggcgat

SEQ ID NO: 119070 - DNA, 25 bp, B. subtillis
ggcccgtgtatgaacgaagccgaca

SEQ ID NO: 119071 - DNA, 25 bp, B. subtillis
gataacctgatctaccaagtggcta

SEQ ID NO: 119072 - DNA, 25 bp, B. subtillis
aaagaaatgcctcctgtccatgtga

SEQ ID NO: 119073 - DNA, 25 bp, B. subtillis
tgaaatccttcacgcatatcagctg

SEQ ID NO: 119074 - DNA, 25 bp, B. subtillis
gaaatcaagcctgtcacattgccga

SEQ ID NO: 119075 - DNA, 25 bp, B. subtillis
gaagccgacatgctgttctctgtca

SEQ ID NO: 119076 - DNA, 25 bp, B. subtillis
gaacacagcggtcgacatttcagaa

SEQ ID NO: 119077 - DNA, 25 bp, B. subtillis
gaagctgaccgtctttgaaagcgac

SEQ ID NO: 119078 - DNA, 25 bp, B. subtillis
attcagtcggaatggcgctcagcag

SEQ ID NO: 119079 - DNA, 25 bp, B. subtillis
atatcagctgatcgcccgtgtagaa

SEQ ID NO: 119080 - DNA, 25 bp, B. subtillis
agaaccaggttcttgcgcgtctatc

SEQ ID NO: 119081 - DNA, 25 bp, B. subtillis
tattcacctgccgaagctgtctgag

SEQ ID NO: 119082 - DNA, 25 bp, B. subtillis
aaatgcattgtcatcatcccgaacg

SEQ ID NO: 119083 - DNA, 25 bp, B. subtillis
aaaattgtccgttccatctgtgaga

SEQ ID NO: 119084 - DNA, 25 bp, B. subtillis
acaccggcgctaactttacatgaag

SEQ ID NO: 119085 - DNA, 25 bp, B. subtillis
aaaactgctgccttcgaagtgtgcg

SEQ ID NO: 119086 - DNA, 25 bp, B. subtillis
actcgctcaagctgtcatgtacgga

SEQ ID NO: 119087 - DNA, 25 bp, B. subtillis
tgagaaatcaccgattgcccttgtc

SEQ ID NO: 119088 - DNA, 25 bp, B. subtillis
gacggaaactttgacgatgcgctta

SEQ ID NO: 119089 - DNA, 25 bp, B. subtillis
gatgttttagcgatcccggtcggaa

SEQ ID NO: 119090 - DNA, 25 bp, B. subtillis
gaaggcgtcaatcctacgggatcat

SEQ ID NO: 119091 - DNA, 25 bp, B. subtillis
gctggaaacatcactgcgtactgga

SEQ ID NO: 119092 - DNA, 25 bp, B. subtillis
gatgcttgtgcctgagctgtcaaaa

SEQ ID NO: 119093 - DNA, 25 bp, B. subtillis
gatcatgtccaaggattggccgctt

SEQ ID NO: 119094 - DNA, 25 bp, B. subtillis
aaatgatccgcgtcccgaatgctga

SEQ ID NO: 119095 - DNA, 25 bp, B. subtillis
aagggcgcatatggaacggctctca

SEQ ID NO: 119096 - DNA, 25 bp, B. subtillis
aaggatatgttccatcagccgtacc

SEQ ID NO: 119097 - DNA, 25 bp, B. subtillis
gagtttccatatgccgatgccgtaa

SEQ ID NO: 119098 - DNA, 25 bp, B. subtillis
gagacgcgagagacgtgcttccgaa

SEQ ID NO: 119099 - DNA, 25 bp, B. subtillis
gacgtagtcgttgtcattccttttt

SEQ ID NO: 119100 - DNA, 25 bp, B. subtillis
gaaggacacccggacaatgctggcg

SEQ ID NO: 119101 - DNA, 25 bp, B. subtillis
gcggacttgtgatcggcctgcatga

SEQ ID NO: 119102 - DNA, 25 bp, B. subtillis
atatcctcattgctgcgatcatgtc

SEQ ID NO: 119103 - DNA, 25 bp, B. subtillis
tagatgcagccgttgcaggcgaagt

SEQ ID NO: 119104 - DNA, 25 bp, B. subtillis
taccgcaccattccggagtgtatag

SEQ ID NO: 119105 - DNA, 25 bp, B. subtillis
ggtccagcagctacatttacacatc

SEQ ID NO: 119106 - DNA, 25 bp, B. subtillis
gttgattttgcttttgttcctttgg

SEQ ID NO: 119107 - DNA, 25 bp, B. subtillis
aaaacggcgccgaacatgttgctta

SEQ ID NO: 119108 - DNA, 25 bp, B. subtillis
aatttactcacattcacacgcgatt

SEQ ID NO: 119109 - DNA, 25 bp, B. subtillis
tgaacagcctttgccaatcgtgggt

SEQ ID NO: 119110 - DNA, 25 bp, B. subtillis
tgaaatgacgttgccgattcaccag

SEQ ID NO: 119111 - DNA, 25 bp, B. subtillis
ctagcagtcagttcttgttttcaaa

SEQ ID NO: 119112 - DNA, 25 bp, B. subtillis
gctcgtccatccctcaagagagaat

SEQ ID NO: 119113 - DNA, 25 bp, B. subtillis
atttcttcatcgacattttccttcc

SEQ ID NO: 119114 - DNA, 25 bp, B. subtillis
ttatctcagcttcttcaggcggtag

SEQ ID NO: 119115 - DNA, 25 bp, B. subtillis
taggtcaggtgcgttatctcagctt

SEQ ID NO: 119116 - DNA, 25 bp, B. subtillis
gattcagtagcagatgccgttcaaa

SEQ ID NO: 119117 - DNA, 25 bp, B. subtillis
gatgccgttcaaaaggtcgatttaa

SEQ ID NO: 119118 - DNA, 25 bp, B. subtillis
acgttctttccattcaccagaccat

SEQ ID NO: 119119 - DNA, 25 bp, B. subtillis
actgtctatcagtacgtcggcaatg

SEQ ID NO: 119120 - DNA, 25 bp, B. subtillis
ctgattctggaagcaacgttctttc

SEQ ID NO: 119121 - DNA, 25 bp, B. subtillis
atcacacttttctttcatttggagg

SEQ ID NO: 119122 - DNA, 25 bp, B. subtillis
aggcagagcaaatgtgacactgtct

SEQ ID NO: 119123 - DNA, 25 bp, B. subtillis
agggatgctgtttttccattctaca

SEQ ID NO: 119124 - DNA, 25 bp, B. subtillis
agaccattccgcttcaaggcagagc

SEQ ID NO: 119125 - DNA, 25 bp, B. subtillis
gtctcccgatgaaaacatatctttt

SEQ ID NO: 119126 - DNA, 25 bp, B. subtillis
gtgctgtctgcattttcttggagaa

SEQ ID NO: 119127 - DNA, 25 bp, B. subtillis
ggcgctgcatagagtgctgtctgca

SEQ ID NO: 119128 - DNA, 25 bp, B. subtillis
tgtcaaaaattgagtcacgtccgac

SEQ ID NO: 119129 - DNA, 25 bp, B. subtillis
aagatttattatcctgtctcccgat

SEQ ID NO: 119130 - DNA, 25 bp, B. subtillis
tgatatggcagcttctacatacgaa

SEQ ID NO: 119131 - DNA, 25 bp, B. subtillis
gagtcacgtccgactaaaaccggat

SEQ ID NO: 119132 - DNA, 25 bp, B. subtillis
gaccttaatggtcatgctgccgcag

SEQ ID NO: 119133 - DNA, 25 bp, B. subtillis
atgctgccgcaggatgatcagtccg

SEQ ID NO: 119134 - DNA, 25 bp, B. subtillis
gctctaggcccaaaacgaccttaat

SEQ ID NO: 119135 - DNA, 25 bp, B. subtillis
attcaaaattgagctctaggcccaa

SEQ ID NO: 119136 - DNA, 25 bp, B. subtillis
tatgaaatcgcgcttcttgaagacc

SEQ ID NO: 119137 - DNA, 25 bp, B. subtillis
ggtttcgatcttcataacggacaaa

SEQ ID NO: 119138 - DNA, 25 bp, B. subtillis
taacggacaaactgaacgggccatt

SEQ ID NO: 119139 - DNA, 25 bp, B. subtillis
taaagaaacgggtcactccatcgat

SEQ ID NO: 119140 - DNA, 25 bp, B. subtillis
gactacattacaacgggccaggaag

SEQ ID NO: 119141 - DNA, 25 bp, B. subtillis
gatcacgcccggagtagaagcgcat

SEQ ID NO: 119142 - DNA, 25 bp, B. subtillis
gaagcgcatacgcatgactacatta

SEQ ID NO: 119143 - DNA, 25 bp, B. subtillis
cgcatcggctgcattgtggtggata

SEQ ID NO: 119144 - DNA, 25 bp, B. subtillis
atcggaacacattcagctgctgggt

SEQ ID NO: 119145 - DNA, 25 bp, B. subtillis
agctgctgggtgtccattgccatat

SEQ ID NO: 119146 - DNA, 25 bp, B. subtillis
agaactgcggatggcgcttgagcac

SEQ ID NO: 119147 - DNA, 25 bp, B. subtillis
gtggctttaatacgtgagcgtgcta

SEQ ID NO: 119148 - DNA, 25 bp, B. subtillis
ggatgctctctatttagcggagaaa

SEQ ID NO: 119149 - DNA, 25 bp, B. subtillis
aaatcggaggtgtggatgctctcta

SEQ ID NO: 119150 - DNA, 25 bp, B. subtillis
actttctttagatgtcgtatccgga

SEQ ID NO: 119151 - DNA, 25 bp, B. subtillis
aagcacaggtggcatatgcgagcaa

SEQ ID NO: 119152 - DNA, 25 bp, B. subtillis
gagagctatatacggctgttgcagc

SEQ ID NO: 119153 - DNA, 25 bp, B. subtillis
gctcgctgaggaagagggactttct

SEQ ID NO: 119154 - DNA, 25 bp, B. subtillis
gcaaagcattctcatcagtcgcaat

SEQ ID NO: 119155 - DNA, 25 bp, B. subtillis
atggtacacctctttacgtatatga

SEQ ID NO: 119156 - DNA, 25 bp, B. subtillis
agtcgcaatgattcagctcgctgag

SEQ ID NO: 119157 - DNA, 25 bp, B. subtillis
aggcgtttatttctgcagggctgaa

SEQ ID NO: 119158 - DNA, 25 bp, B. subtillis
tattcatttgtatccaaggtgctga

SEQ ID NO: 119159 - DNA, 25 bp, B. subtillis
ttcggtattcgttatacggaagatg

SEQ ID NO: 119160 - DNA, 25 bp, B. subtillis
tgcttcccgttacggttttgacatt

SEQ ID NO: 119161 - DNA, 25 bp, B. subtillis
tcttggaggaggtttcggtattcgt

SEQ ID NO: 119162 - DNA, 25 bp, B. subtillis
gacattccggaaatttggatcgaac

SEQ ID NO: 119163 - DNA, 25 bp, B. subtillis
gctgtgaaagaaaatgcttcccgtt

SEQ ID NO: 119164 - DNA, 25 bp, B. subtillis
gccggttttgtgttagcagcggaaa

SEQ ID NO: 119165 - DNA, 25 bp, B. subtillis
gcttcatgccactgaatacgttgaa

SEQ ID NO: 119166 - DNA, 25 bp, B. subtillis
gaagatgatgaaccgcttcatgcca

SEQ ID NO: 119167 - DNA, 25 bp, B. subtillis
tcgaaccgggccgttctctcgtggg

SEQ ID NO: 119168 - DNA, 25 bp, B. subtillis
atacggccggttttgtgttagcagc

SEQ ID NO: 119169 - DNA, 25 bp, B. subtillis
ttttggcgcccacagtgatgatgtc

SEQ ID NO: 119170 - DNA, 25 bp, B. subtillis
gtgttttcgaattccgtgaccttct

SEQ ID NO: 119171 - DNA, 25 bp, B. subtillis
ggatgtctcggcattaatccgttta

SEQ ID NO: 119172 - DNA, 25 bp, B. subtillis
ggaaattcttgtgcgcacacttgat

SEQ ID NO: 119173 - DNA, 25 bp, B. subtillis
aaatcggtgcactgatcgctgccaa

SEQ ID NO: 119174 - DNA, 25 bp, B. subtillis
aattgctttgatcgcgcatgacaag

SEQ ID NO: 119175 - DNA, 25 bp, B. subtillis
gccaatgcactcgatcttgtcattt

SEQ ID NO: 119176 - DNA, 25 bp, B. subtillis
gaatcatgatctatacgcaaccgga

SEQ ID NO: 119177 - DNA, 25 bp, B. subtillis
attccgctcgccacaaatatgggta

SEQ ID NO: 119178 - DNA, 25 bp, B. subtillis
atggttcaatttacgactgcctatc

SEQ ID NO: 119179 - DNA, 25 bp, B. subtillis
atgtgatgtgtattccattccgctc

SEQ ID NO: 119180 - DNA, 25 bp, B. subtillis
ttgcattagagcacggagtccgtcc

SEQ ID NO: 119181 - DNA, 25 bp, B. subtillis
gggccatagaccatacatacgatca

SEQ ID NO: 119182 - DNA, 25 bp, B. subtillis
ggaacaaccggtttctcagaagctg

SEQ ID NO: 119183 - DNA, 25 bp, B. subtillis
gattattgagcttcatcatgaccag

SEQ ID NO: 119184 - DNA, 25 bp, B. subtillis
aaatggctgccaactattttgagga

SEQ ID NO: 119185 - DNA, 25 bp, B. subtillis
aaagggatcggagccatcatcgcgc

SEQ ID NO: 119186 - DNA, 25 bp, B. subtillis
gagtcagatgctttcatttacacag

SEQ ID NO: 119187 - DNA, 25 bp, B. subtillis
gagtccgtccagttgtcggaacaac

SEQ ID NO: 119188 - DNA, 25 bp, B. subtillis
caaattttgcgctcggtgcgatact

SEQ ID NO: 119189 - DNA, 25 bp, B. subtillis
atctgatgtgatgcctgttgagtca

SEQ ID NO: 119190 - DNA, 25 bp, B. subtillis
agatatccatgcctgttttacagaa

SEQ ID NO: 119191 - DNA, 25 bp, B. subtillis
ttcggtcaattgtcactgtcatcag

SEQ ID NO: 119192 - DNA, 25 bp, B. subtillis
aaaaggatcgccatccggatcacgg

SEQ ID NO: 119193 - DNA, 25 bp, B. subtillis
gaactctcttctaacggtacggtca

SEQ ID NO: 119194 - DNA, 25 bp, B. subtillis
cagaccgcggcctaataatgagtga

SEQ ID NO: 119195 - DNA, 25 bp, B. subtillis
caaaagccagtttatcccgtcaaag

SEQ ID NO: 119196 - DNA, 25 bp, B. subtillis
gccttccggcgcataaagtcagcaa

SEQ ID NO: 119197 - DNA, 25 bp, B. subtillis
gaatctgtcggccaaaagcggtttt

SEQ ID NO: 119198 - DNA, 25 bp, B. subtillis
gaagcagcccgcatattaggcgcag

SEQ ID NO: 119199 - DNA, 25 bp, B. subtillis
gaagaagcgatcttttccgccggaa

SEQ ID NO: 119200 - DNA, 25 bp, B. subtillis
agaattcagctaacgcttccagacc

SEQ ID NO: 119201 - DNA, 25 bp, B. subtillis
atggttttcatcagccggattttgt

SEQ ID NO: 119202 - DNA, 25 bp, artificial sequence
  synthetic oligonucleotide
gtatgatgctgtaccatcctgcgat

SEQ ID NO: 119203 - DNA, 25 bp, artificial sequence
  synthetic oligonucleotide
ggtgcaaggctcctagcatgtagtc

SEQ ID NO: 119204 - DNA, 25 bp, artificial sequence
  synthetic oligonucleotide
gataacgatgccgctgactctacgg

SEQ ID NO: 119205 - DNA, 25 bp, artificial sequence
  synthetic oligonucleotide
tgcgtctgagcctgagctacagcga

SEQ ID NO: 119206 - DNA, 25 bp, artificial sequence
  synthetic oligonucleotide
tcagaacctcagctcatcatgtatg

SEQ ID NO: 119207 - DNA, 25 bp, artificial sequence
  synthetic oligonucleotide
gagcgtatttgctgtcagaacctca

SEQ ID NO: 119208 - DNA, 25 bp, artificial sequence
  synthetic oligonucleotide
gactctacggtaatgcacgatcctc

SEQ ID NO: 119209 - DNA, 25 bp, artificial sequence
  synthetic oligonucleotide
gcaccgctataatgcgaggctctcc

SEQ ID NO: 119210 - DNA, 25 bp, artificial sequence
  synthetic oligonucleotide
gcacgatcctctacattgatagcag

SEQ ID NO: 119211 - DNA, 25 bp, artificial sequence
  synthetic oligonucleotide
agcgagtcgaatccaatgccgtagc

SEQ ID NO: 119212 - DNA, 25 bp, artificial sequence
  synthetic oligonucleotide
aggtctgcgactgatcctagtgcaa

SEQ ID NO: 119213 - DNA, 25 bp, artificial sequence
  synthetic oligonucleotide
taggcaaacgtctgtcggtcatggc

SEQ ID NO: 119214 - DNA, 25 bp, artificial sequence
  synthetic oligonucleotide
gtagaccgacgttatcgcgctatac

SEQ ID NO: 119215 - DNA, 25 bp, artificial sequence
  synthetic oligonucleotide
gtcaagcgtgctcctacgttagtat

SEQ ID NO: 119216 - DNA, 25 bp, artificial sequence
  synthetic oligonucleotide
gtgatgttctcggatcgacactgct

SEQ ID NO: 119217 - DNA, 25 bp, artificial sequence
  synthetic oligonucleotide
ggatgcacgttatcgtcgagtggcc

SEQ ID NO: 119218 - DNA, 25 bp, artificial sequence
  synthetic oligonucleotide
gattcgcacgacttcagaggatggc

SEQ ID NO: 119219 - DNA, 25 bp, artificial sequence
  synthetic oligonucleotide
gacactgctggtctgcgaatgactc

SEQ ID NO: 119220 - DNA, 25 bp, artificial sequence
  synthetic oligonucleotide
gcggcctatgtctcattagcgagtc

SEQ ID NO: 119221 - DNA, 25 bp, artificial sequence
  synthetic oligonucleotide
gctatacccgatgtcaacgcgagtt

SEQ ID NO: 119222 - DNA, 25 bp, artificial sequence
  synthetic oligonucleotide
gtatcagtttccctattggtacgtc

SEQ ID NO: 119223 - DNA, 25 bp, artificial sequence
  synthetic oligonucleotide
atatgggctcggttgacctctattg

SEQ ID NO: 119224 - DNA, 25 bp, artificial sequence
  synthetic oligonucleotide
gtatcctgatcgtgcgtgcgatgtc

SEQ ID NO: 119225 - DNA, 25 bp, artificial sequence
  synthetic oligonucleotide
ggagctatataagccgctgttgcgt

SEQ ID NO: 119226 - DNA, 25 bp, artificial sequence
  synthetic oligonucleotide
gatatgtattgcgctcagatgctgg

SEQ ID NO: 119227 - DNA, 25 bp, artificial sequence
  synthetic oligonucleotide
tgccatgcgtgctgtcagtatgcca

SEQ ID NO: 119228 - DNA, 25 bp, artificial sequence
  synthetic oligonucleotide
tcaacggcatgatccctatgaccgc

SEQ ID NO: 119229 - DNA, 25 bp, artificial sequence
  synthetic oligonucleotide
gagcagcagtcggctatgatttgca

SEQ ID NO: 119230 - DNA, 25 bp, artificial sequence
  synthetic oligonucleotide
gagccgcaatgcacgactgatactc

SEQ ID NO: 119231 - DNA, 25 bp, artificial sequence
  synthetic oligonucleotide
gagttgtcgcagtgtctgtaccaat

SEQ ID NO: 119232 - DNA, 25 bp, artificial sequence
  synthetic oligonucleotide
cgatgtctgataatacgctcgcatg

SEQ ID NO: 119233 - DNA, 25 bp, artificial sequence
  synthetic oligonucleotide
catgctaactgatacacgctgctcg

SEQ ID NO: 119234 - DNA, 25 bp, artificial sequence
  synthetic oligonucleotide
gctgctcgaacagtgatacgcacac

SEQ ID NO: 119235 - DNA, 25 bp, artificial sequence
  synthetic oligonucleotide
tagcccgacactgtgctcgataaga

SEQ ID NO: 119236 - DNA, 25 bp, artificial sequence
  synthetic oligonucleotide
gtagctggtgcatgtactcgactgc

SEQ ID NO: 119237 - DNA, 25 bp, artificial sequence
  synthetic oligonucleotide
gatcacggtgccacaacatgctaca

SEQ ID NO: 119238 - DNA, 25 bp, artificial sequence
  synthetic oligonucleotide
actggctgtctagcactgtagctgg

SEQ ID NO: 119239 - DNA, 25 bp, artificial sequence
  synthetic oligonucleotide
tgaccttatcgacgcgcatgtgagc

SEQ ID NO: 119240 - DNA, 25 bp, artificial sequence
  synthetic oligonucleotide
tctatcccgtggactcaacgtgcat

SEQ ID NO: 119241 - DNA, 25 bp, artificial sequence
  synthetic oligonucleotide
gagtgctacgcctaaactggctgtc

SEQ ID NO: 119242 - DNA, 25 bp, artificial sequence
  synthetic oligonucleotide
ctatgctgagcgcgtatctgtgtac

SEQ ID NO: 119243 - DNA, 25 bp, artificial sequence
  synthetic oligonucleotide
cgatgtgagcactctcatctgcgga

SEQ ID NO: 119244 - DNA, 25 bp, artificial sequence
  synthetic oligonucleotide
atataccgctgctgcactgatatga

SEQ ID NO: 119245 - DNA, 25 bp, artificial sequence
  synthetic oligonucleotide
atcagcttgcgcctattatatgcct

SEQ ID NO: 119246 - DNA, 25 bp, artificial sequence
  synthetic oligonucleotide
gtgacgcagctcttagcgcaatgta

SEQ ID NO: 119247 - DNA, 25 bp, artificial sequence
  synthetic oligonucleotide
acgtctgatgacctcgtatcatgtt

SEQ ID NO: 119248 - DNA, 25 bp, artificial sequence
  synthetic oligonucleotide
aacgctatggcgtgctagtcgtctc

SEQ ID NO: 119249 - DNA, 25 bp, artificial sequence
  synthetic oligonucleotide
tcgcatcctatcttacgtgtcagta

SEQ ID NO: 119250 - DNA, 25 bp, artificial sequence
  synthetic oligonucleotide
cgatgatggtcacgactctgtcgat

SEQ ID NO: 119251 - DNA, 25 bp, artificial sequence
  synthetic oligonucleotide
gcctagtacgctgacggcattcaga

SEQ ID NO: 119252 - DNA, 25 bp, artificial sequence
  synthetic oligonucleotide
gctagtcgtctcatatacgtctgat

SEQ ID NO: 119253 - DNA, 25 bp, artificial sequence
  synthetic oligonucleotide
gcagcctatatgatacgcagtcgca

SEQ ID NO: 119254 - DNA, 25 bp, artificial sequence
  synthetic oligonucleotide
atgataggctagtctcgcgcagtac

SEQ ID NO: 119255 - DNA, 25 bp, artificial sequence
  synthetic oligonucleotide
agagtacgctgatcggcttatgacg

SEQ ID NO: 119256 - DNA, 25 bp, artificial sequence
  synthetic oligonucleotide
agggctgcgaactgtcgatgatggt

SEQ ID NO: 119257 - DNA, 25 bp, artificial sequence
  synthetic oligonucleotide
tgtcgtaagccagtgtgtcgtgtct

SEQ ID NO: 119258 - DNA, 25 bp, artificial sequence
  synthetic oligonucleotide
gtcggcaagcacttagtcgtgtcgt

SEQ ID NO: 119259 - DNA, 25 bp, artificial sequence
  synthetic oligonucleotide
taatatctgaccacgccttgtaatc

SEQ ID NO: 119260 - DNA, 25 bp, artificial sequence
  synthetic oligonucleotide
tcggctgatataggtcgtggctccc

SEQ ID NO: 119261 - DNA, 25 bp, artificial sequence
  synthetic oligonucleotide
gacacgcgcttgacacgactgaatc

SEQ ID NO: 119262 - DNA, 25 bp, artificial sequence
  synthetic oligonucleotide
gagtctatctggatcaacgtcgcac

SEQ ID NO: 119263 - DNA, 25 bp, artificial sequence
  synthetic oligonucleotide
gagtctctcttagcatagtgtccgc

SEQ ID NO: 119264 - DNA, 25 bp, artificial sequence
  synthetic oligonucleotide
cgttacggtcgctgcgtactgtata

SEQ ID NO: 119265 - DNA, 25 bp, artificial sequence
  synthetic oligonucleotide
cgtggctccctgtatatcgaggtga

SEQ ID NO: 119266 - DNA, 25 bp, artificial sequence
  synthetic oligonucleotide
gaatccagcttaagagccctgcaac

SEQ ID NO: 119267 - DNA, 25 bp, artificial sequence
  synthetic oligonucleotide
ataggatgcggcgatctcatacagc

SEQ ID NO: 119268 - DNA, 25 bp, artificial sequence
  synthetic oligonucleotide
ttatcgggcctgctacatcagtggc

SEQ ID NO: 119269 - DNA, 25 bp, artificial sequence
  synthetic oligonucleotide
tatagcgccctgtggtcgtataatc

SEQ ID NO: 119270 - DNA, 25 bp, artificial sequence
  synthetic oligonucleotide
ggctcagtggtccgacatagtgccc

SEQ ID NO: 119271 - DNA, 25 bp, artificial sequence
  synthetic oligonucleotide
gtggcgatgttcgtaacccttagcc

SEQ ID NO: 119272 - DNA, 25 bp, artificial sequence
  synthetic oligonucleotide
gatccagatcgcagggtatcgcatc

SEQ ID NO: 119273 - DNA, 25 bp, artificial sequence
  synthetic oligonucleotide
acttctcggtatgtgtcctcaatta

SEQ ID NO: 119274 - DNA, 25 bp, artificial sequence
  synthetic oligonucleotide
tcgcggctcactaattgtctgcggt

SEQ ID NO: 119275 - DNA, 25 bp, artificial sequence
  synthetic oligonucleotide
tcgtcgtgacgaacgtgctactcgc

SEQ ID NO: 119276 - DNA, 25 bp, artificial sequence
  synthetic oligonucleotide
gagccgatggtcagcaatagcgcct

SEQ ID NO: 119277 - DNA, 25 bp, artificial sequence
  synthetic oligonucleotide
cactatgccacctctggtctaatat

SEQ ID NO: 119278 - DNA, 25 bp, artificial sequence
  synthetic oligonucleotide
cttagccgatcttcttacttacgag

SEQ ID NO: 119279 - DNA, 25 bp, artificial sequence
  synthetic oligonucleotide
tataatggcgtctgtcgtgctcata

SEQ ID NO: 119280 - DNA, 25 bp, artificial sequence
  synthetic oligonucleotide
tatcaatactcgtccgcaggtgaac

SEQ ID NO: 119281 - DNA, 25 bp, artificial sequence
  synthetic oligonucleotide
gtgctccgtgcgaaatacgcggtca

SEQ ID NO: 119282 - DNA, 25 bp, artificial sequence
  synthetic oligonucleotide
ggtcaatgtcagtacggatcgcgtc

SEQ ID NO: 119283 - DNA, 25 bp, artificial sequence
  synthetic oligonucleotide
gtcagttgccactcgttgatagtca

SEQ ID NO: 119284 - DNA, 25 bp, artificial sequence
  synthetic oligonucleotide
gtcgatctaggtgactacgcacgcc

SEQ ID NO: 119285 - DNA, 25 bp, artificial sequence
  synthetic oligonucleotide
tgaatagtgtcgtaggctctcgggc

SEQ ID NO: 119286 - DNA, 25 bp, artificial sequence
  synthetic oligonucleotide
tgctagacgtgtccatcgagctgca

SEQ ID NO: 119287 - DNA, 25 bp, artificial sequence
  synthetic oligonucleotide
gctgcatagctatacttcgagtcac

SEQ ID NO: 119288 - DNA, 25 bp, artificial sequence
  synthetic oligonucleotide
gcacgttgttaaactgttgccgcca

SEQ ID NO: 119289 - DNA, 25 bp, artificial sequence
  synthetic oligonucleotide
agactcgtccctcgatatcaatact

SEQ ID NO: 119290 - DNA, 25 bp, artificial sequence
  synthetic oligonucleotide
taggtggctctaatctgcgttggtt

SEQ ID NO: 119291 - DNA, 25 bp, artificial sequence
  synthetic oligonucleotide
gtcgctcacagtgtctggtgttcga

SEQ ID NO: 119292 - DNA, 25 bp, artificial sequence
  synthetic oligonucleotide
gtaatgacgctgcatcgctcagtat

SEQ ID NO: 119293 - DNA, 25 bp, artificial sequence
  synthetic oligonucleotide
aaacctctgggcatccgtattaagc

SEQ ID NO: 119294 - DNA, 25 bp, artificial sequence
  synthetic oligonucleotide
acatccagtggtgagtcgctacatc

SEQ ID NO: 119295 - DNA, 25 bp, artificial sequence
  synthetic oligonucleotide
gacagcagctcagcatctatgcatc

SEQ ID NO: 119296 - DNA, 25 bp, artificial sequence
  synthetic oligonucleotide
gacattcctacgacttatcagcacg

SEQ ID NO: 119297 - DNA, 25 bp, artificial sequence
  synthetic oligonucleotide
ctaggacatcatgctcgactctgag

SEQ ID NO: 119298 - DNA, 25 bp, artificial sequence
  synthetic oligonucleotide
gcatcatgtgcctcactaggacatc

SEQ ID NO: 119299 - DNA, 25 bp, artificial sequence
  synthetic oligonucleotide
attctcggtggtgctcagtacatcc

SEQ ID NO: 119300 - DNA, 25 bp, artificial sequence
  synthetic oligonucleotide
agagatgcttagtacgccttcgaat

SEQ ID NO: 119301 - DNA, 25 bp, artificial sequence
  synthetic oligonucleotide
tatcgccatgtctgtcaactgtact

SEQ ID NO: 119302 - DNA, 25 bp, artificial sequence
  synthetic oligonucleotide
tagtgccgtcggttcaggtcatatg

SEQ ID NO: 119303 - DNA, 25 bp, artificial sequence
  synthetic oligonucleotide
ttggatggtgcagcttacttcgcgt

SEQ ID NO: 119304 - DNA, 25 bp, artificial sequence
  synthetic oligonucleotide
gtcaggcaatgtgtccgaacggcga

SEQ ID NO: 119305 - DNA, 25 bp, artificial sequence
  synthetic oligonucleotide
tggcagccgaatggactatcgctcc

SEQ ID NO: 119306 - DNA, 25 bp, artificial sequence
  synthetic oligonucleotide
gtcaccgctatctcgtaaggggtcc

SEQ ID NO: 119307 - DNA, 25 bp, artificial sequence
  synthetic oligonucleotide
acgtcgcctcacggagtaatcgcgt

SEQ ID NO: 119308 - DNA, 25 bp, artificial sequence
  synthetic oligonucleotide
tcggacctaaaccgtagctctcggc

SEQ ID NO: 119309 - DNA, 25 bp, artificial sequence
  synthetic oligonucleotide
tctaagcgctcgatattccacctaa

SEQ ID NO: 119310 - DNA, 25 bp, artificial sequence
  synthetic oligonucleotide
agtcctctgcatctataatcgcgta

SEQ ID NO: 119311 - DNA, 25 bp, artificial sequence
  synthetic oligonucleotide
agatcgtcctcgtctcgaatatagc

SEQ ID NO: 119312 - DNA, 25 bp, artificial sequence
  synthetic oligonucleotide
ttgacgaactctccggtatatgctc

SEQ ID NO: 119313 - DNA, 25 bp, artificial sequence
  synthetic oligonucleotide
gtgacatgagtctagcttcgcggtc

SEQ ID NO: 119314 - DNA, 25 bp, artificial sequence
  synthetic oligonucleotide
gtgcgccgaatgtgtctgtaatgcc

SEQ ID NO: 119315 - DNA, 25 bp, artificial sequence
  synthetic oligonucleotide
gatcctcgctaagtattcagccacc

SEQ ID NO: 119316 - DNA, 25 bp, artificial sequence
  synthetic oligonucleotide
tcagccacctcgtatagtattcgcg

SEQ ID NO: 119317 - DNA, 25 bp, artificial sequence
  synthetic oligonucleotide
gacatctacgggcggctattgacga

SEQ ID NO: 119318 - DNA, 25 bp, artificial sequence
  synthetic oligonucleotide
gagcgtctcctaaatagatccggtc

SEQ ID NO: 119319 - DNA, 25 bp, artificial sequence
  synthetic oligonucleotide
gcctgcgaatgagtcgtcagtgccc

SEQ ID NO: 119320 - DNA, 25 bp, artificial sequence
  synthetic oligonucleotide
gctgatacgctagggtgcttgctac

SEQ ID NO: 119321 - DNA, 25 bp, artificial sequence
  synthetic oligonucleotide
atatggcgactgtgtccgtctatac

SEQ ID NO: 119322 - DNA, 25 bp, artificial sequence
  synthetic oligonucleotide
agatccggtcttatcgctgaatgtc

SEQ ID NO: 119323 - DNA, 25 bp, artificial sequence
  synthetic oligonucleotide
ttcctctcagtcacgtatggttcgc

SEQ ID NO: 119324 - DNA, 25 bp, artificial sequence
  synthetic oligonucleotide
gtatgcagtgcggtatggttcctct

SEQ ID NO: 119325 - DNA, 25 bp, artificial sequence
  synthetic oligonucleotide
gtgtcaccacgcggtacatgagtca

SEQ ID NO: 119326 - DNA, 25 bp, artificial sequence
  synthetic oligonucleotide
gtctaatcgccgttggtctgtatgc

SEQ ID NO: 119327 - DNA, 25 bp, artificial sequence
  synthetic oligonucleotide
ggcgtcggattagaccggatcaccc

SEQ ID NO: 119328 - DNA, 25 bp, artificial sequence
  synthetic oligonucleotide
caattcgggctagtcgtacctgaac

SEQ ID NO: 119329 - DNA, 25 bp, artificial sequence
  synthetic oligonucleotide
aacgggcatcagtcgaatctcttcg

SEQ ID NO: 119330 - DNA, 25 bp, artificial sequence
  synthetic oligonucleotide
aacctatccctgagtctatatgcgt

SEQ ID NO: 119331 - DNA, 25 bp, artificial sequence
  synthetic oligonucleotide
tgacacatctcctcgttggtagtac

SEQ ID NO: 119332 - DNA, 25 bp, artificial sequence
  synthetic oligonucleotide
attcggcggtgcctcacaatattcc

SEQ ID NO: 119333 - DNA, 25 bp, artificial sequence
  synthetic oligonucleotide
agcccgctatggtgagtctaatcgc

SEQ ID NO: 119334 - DNA, 25 bp, artificial sequence
  synthetic oligonucleotide
tacagcttacctactatgcgtgcaa

SEQ ID NO: 119335 - DNA, 25 bp, artificial sequence
  synthetic oligonucleotide
ttaccgagctgacgtcgcgttagac

SEQ ID NO: 119336 - DNA, 25 bp, artificial sequence
  synthetic oligonucleotide
gtcgtctagcttaatacctctgcgt

SEQ ID NO: 119337 - DNA, 25 bp, artificial sequence
  synthetic oligonucleotide
ggatcgcttaacctctatgcgtaca

SEQ ID NO: 119338 - DNA, 25 bp, artificial sequence
  synthetic oligonucleotide
ggcgcgttcgacataattgccgacg

SEQ ID NO: 119339 - DNA, 25 bp, artificial sequence
  synthetic oligonucleotide
gatcacgttagatccactgcgtcac

SEQ ID NO: 119340 - DNA, 25 bp, artificial sequence
  synthetic oligonucleotide
tgcgaggttcgcttacgttgcatag

SEQ ID NO: 119341 - DNA, 25 bp, artificial sequence
  synthetic oligonucleotide
tgcgtcacgttacctacatgatcga

SEQ ID NO: 119342 - DNA, 25 bp, artificial sequence
  synthetic oligonucleotide
gagtcctgcacgttagaacactggc

SEQ ID NO: 119343 - DNA, 25 bp, artificial sequence
  synthetic oligonucleotide
gcgttagacagctcattcgtcacgt

SEQ ID NO: 119344 - DNA, 25 bp, artificial sequence
  synthetic oligonucleotide
agtcactctcgacctagcgtaagga

SEQ ID NO: 119345 - DNA, 25 bp, artificial sequence
  synthetic oligonucleotide
ttcgtgactagcaggccttattccg

SEQ ID NO: 119346 - DNA, 25 bp, artificial sequence
  synthetic oligonucleotide
gtctatgaggtctcgtcttcgtgag

SEQ ID NO: 119347 - DNA, 25 bp, artificial sequence
  synthetic oligonucleotide
ggaacagtctaacctacgcgagata

SEQ ID NO: 119348 - DNA, 25 bp, artificial sequence
  synthetic oligonucleotide
acgcgagatacgtcttaccgcacat

SEQ ID NO: 119349 - DNA, 25 bp, artificial sequence
  synthetic oligonucleotide
acgcggagtcaacctgataacccat

SEQ ID NO: 119350 - DNA, 25 bp, artificial sequence
  synthetic oligonucleotide
actagcctgccggtcaataactgat

SEQ ID NO: 119351 - DNA, 25 bp, artificial sequence
  synthetic oligonucleotide
aattatcggaactcgtcgcttattt

SEQ ID NO: 119352 - DNA, 25 bp, artificial sequence
  synthetic oligonucleotide
gagtcgggtactacattcgtgcgat

SEQ ID NO: 119353 - DNA, 25 bp, artificial sequence
  synthetic oligonucleotide
gccttattccggtgctatgagtatc

SEQ ID NO: 119354 - DNA, 25 bp, artificial sequence
  synthetic oligonucleotide
accttgggagccgttcctaaagctg

SEQ ID NO: 119355 - DNA, 25 bp, artificial sequence
  synthetic oligonucleotide
atgccgcatattcggaacgtcgcct

SEQ ID NO: 119356 - DNA, 25 bp, artificial sequence
  synthetic oligonucleotide
ttattggatggcgttccgtcctatt

SEQ ID NO: 119357 - DNA, 25 bp, artificial sequence
  synthetic oligonucleotide
tacggctgattctctaggcttacgc

SEQ ID NO: 119358 - DNA, 25 bp, artificial sequence
  synthetic oligonucleotide
ggctgtgcctaacgaatctgggacg

SEQ ID NO: 119359 - DNA, 25 bp, artificial sequence
  synthetic oligonucleotide
acgtgcctaagtaatctggtccgcg

SEQ ID NO: 119360 - DNA, 25 bp, artificial sequence
  synthetic oligonucleotide
aagcgtccaatgtacctatatcgtg

SEQ ID NO: 119361 - DNA, 25 bp, artificial sequence
  synthetic oligonucleotide
tctgaacctgtccatagtatcctgt

SEQ ID NO: 119362 - DNA, 25 bp, artificial sequence
  synthetic oligonucleotide
tgcgtagttctgtcatagcgtcgag

SEQ ID NO: 119363 - DNA, 25 bp, artificial sequence
  synthetic oligonucleotide
gtacggtgatcgtggacgcttgacc

SEQ ID NO: 119364 - DNA, 25 bp, artificial sequence
  synthetic oligonucleotide
caaagttacgtcgcattctctcacg

SEQ ID NO: 119365 - DNA, 25 bp, artificial sequence
  synthetic oligonucleotide
cttacgcgcatgagctctaggttcc

SEQ ID NO: 119366 - DNA, 25 bp, artificial sequence
  synthetic oligonucleotide
gctaagccattacgcgacattctgc

SEQ ID NO: 119367 - DNA, 25 bp, artificial sequence
  synthetic oligonucleotide
ttaactcgactgccgcgtgaacaac

SEQ ID NO: 119368 - DNA, 25 bp, artificial sequence
  synthetic oligonucleotide
gggccgccagagttatgtttgagtc

SEQ ID NO: 119369 - DNA, 25 bp, artificial sequence
  synthetic oligonucleotide
gtgctatatccttaccgcgtatgga

SEQ ID NO: 119370 - DNA, 25 bp, artificial sequence
  synthetic oligonucleotide
gatggctcacgtcttatttgggccg

SEQ ID NO: 119371 - DNA, 25 bp, artificial sequence
  synthetic oligonucleotide
actagcatctaagcactcggctcta

SEQ ID NO: 119372 - DNA, 25 bp, artificial sequence
  synthetic oligonucleotide
tacaggcgcgacgaaccttatactc

SEQ ID NO: 119373 - DNA, 25 bp, artificial sequence
  synthetic oligonucleotide
tgagtcttcgatgtatgcgctcgtt

SEQ ID NO: 119374 - DNA, 25 bp, artificial sequence
  synthetic oligonucleotide
gatcgaaggtcggaactccagtgcc

SEQ ID NO: 119375 - DNA, 25 bp, artificial sequence
  synthetic oligonucleotide
gagaccgggctaaggcacgtatcat

SEQ ID NO: 119376 - DNA, 25 bp, artificial sequence
  synthetic oligonucleotide
cacgtatcatatccctaattcgctg

SEQ ID NO: 119377 - DNA, 25 bp, artificial sequence
  synthetic oligonucleotide
catttgtctaccttaccgtcaagaa

SEQ ID NO: 119378 - DNA, 25 bp, artificial sequence
  synthetic oligonucleotide
ttcaagtaccttagctcgtcggacg

SEQ ID NO: 119379 - DNA, 25 bp, artificial sequence
  synthetic oligonucleotide
gtatcgcttcgcgtgtcatgacttg

SEQ ID NO: 119380 - DNA, 25 bp, artificial sequence
  synthetic oligonucleotide
ggctcagatcttagcactcgtgcag

SEQ ID NO: 119381 - DNA, 25 bp, artificial sequence
  synthetic oligonucleotide
gttgcgctctttggtaaacggctca

SEQ ID NO: 119382 - DNA, 25 bp, artificial sequence
  synthetic oligonucleotide
tctctctaggagcggcttcgcacaa

SEQ ID NO: 119383 - DNA, 25 bp, artificial sequence
  synthetic oligonucleotide
taatctcagaatccgtacagccgca

SEQ ID NO: 119384 - DNA, 25 bp, artificial sequence
  synthetic oligonucleotide
gcgccggttaagccgctattagcgt

SEQ ID NO: 119385 - DNA, 25 bp, artificial sequence
  synthetic oligonucleotide
gctcaatcctagatacgttgcgctc

SEQ ID NO: 119386 - DNA, 25 bp, artificial sequence
  synthetic oligonucleotide
gcactgacacgcgatgacgttcgtc

SEQ ID NO: 119387 - DNA, 25 bp, artificial sequence
  synthetic oligonucleotide
gggtcggctcaacagtgtatccggt

SEQ ID NO: 119388 - DNA, 25 bp, artificial sequence
  synthetic oligonucleotide
acgatggcaagtcgtgcctcgttct

SEQ ID NO: 119389 - DNA, 25 bp, S. pombe
ttacctttgggacgtggtctcttgc

SEQ ID NO: 119390 - DNA, 25 bp, S. pombe
ttggctactggttcctacacagaga

SEQ ID NO: 119391 - DNA, 25 bp, S. pombe
gtcaagctacaatatgcatctggtg

SEQ ID NO: 119392 - DNA, 25 bp, S. pombe
gggtattatacaaggcctcaaagaa

SEQ ID NO: 119393 - DNA, 25 bp, S. pombe
gtacaaaattgcttcttgggctcat

SEQ ID NO: 119394 - DNA, 25 bp, S. pombe
ggtctcttgcttttggctgaaatgt

SEQ ID NO: 119395 - DNA, 25 bp, S. pombe
tgaggatcgcaaattcgcagacatt

SEQ ID NO: 119396 - DNA, 25 bp, S. pombe
caaaggctctttggctactggttcc

SEQ ID NO: 119397 - DNA, 25 bp, S. pombe
aattgccatacagtgccaggcgagg

SEQ ID NO: 119398 - DNA, 25 bp, S. pombe
gacattggaaataccgtcaagctac

SEQ ID NO: 119399 - DNA, 25 bp, S. pombe
gcttcttgggctcatatcacaaatt

SEQ ID NO: 119400 - DNA, 25 bp, S. pombe
ttcaaagctattcagctagagctga

SEQ ID NO: 119401 - DNA, 25 bp, S. pombe
gtggccttaggtaaaaagcatcgtt

SEQ ID NO: 119402 - DNA, 25 bp, S. pombe
ggtagataaaattggaccctatgtc

SEQ ID NO: 119403 - DNA, 25 bp, S. pombe
ggaccctatgtctgtgttatcaaga

SEQ ID NO: 119404 - DNA, 25 bp, S. pombe
aaagcaacttgtcagtcgcggtcga

SEQ ID NO: 119405 - DNA, 25 bp, S. pombe
acacatattgacgttgtcgaggatt

SEQ ID NO: 119406 - DNA, 25 bp, S. pombe
tcagtcgcggtcgatttgacgaaga

SEQ ID NO: 119407 - DNA, 25 bp, S. pombe
tcgaggatttcgaccaggatatggt

SEQ ID NO: 119408 - DNA, 25 bp, S. pombe
gaaaaatcccattgccaaggaattg

SEQ ID NO: 119409 - DNA, 25 bp, S. pombe
caaggaattgttggctttgatggaa

SEQ ID NO: 119410 - DNA, 25 bp, S. pombe
atggtagaaaaactggtggccttag

SEQ ID NO: 119411 - DNA, 25 bp, S. pombe
gggacagcaatatcgtactcctgaa

SEQ ID NO: 119412 - DNA, 25 bp, S. pombe
ggagtctatggagctggtcgtaatc

SEQ ID NO: 119413 - DNA, 25 bp, S. pombe
gtcgtaatcctgttgtcgaagccaa

SEQ ID NO: 119414 - DNA, 25 bp, S. pombe
gtcgatttcctaaccttcaaagcga

SEQ ID NO: 119415 - DNA, 25 bp, S. pombe
ggctttatagctggtcgtcgatttc

SEQ ID NO: 119416 - DNA, 25 bp, S. pombe
aactgcggtagcgatatcatcattg

SEQ ID NO: 119417 - DNA, 25 bp, S. pombe
tcatcattgttggtcgtggagtcta

SEQ ID NO: 119418 - DNA, 25 bp, S. pombe
tacataactatgtcccctggtatcg

SEQ ID NO: 119419 - DNA, 25 bp, S. pombe
gagaagctggttggaaggcatatca

SEQ ID NO: 119420 - DNA, 25 bp, S. pombe
ccctggtatcggcttggatgttaaa

SEQ ID NO: 119421 - DNA, 25 bp, S. pombe
aggcatatcagcaaagactttctca

SEQ ID NO: 119422 - DNA, 25 bp, S. pombe
ttcgcgtctggtaaaatggttgttt

SEQ ID NO: 119423 - DNA, 25 bp, S. pombe
ttatgcgtatccgtgaacccaagtc

SEQ ID NO: 119424 - DNA, 25 bp, S. pombe
gtgaacccaagtctactgcattgat

SEQ ID NO: 119425 - DNA, 25 bp, S. pombe
ggttttaatgccaagttcacggatt

SEQ ID NO: 119426 - DNA, 25 bp, S. pombe
gttttgccgctgttattatgcgtat

SEQ ID NO: 119427 - DNA, 25 bp, S. pombe
actgcattgattttcgcgtctggta

SEQ ID NO: 119428 - DNA, 25 bp, S. pombe
tacaacccaaaacgttttgccgctg

SEQ ID NO: 119429 - DNA, 25 bp, S. pombe
gaaagtatgcgcgtatcatccaaaa

SEQ ID NO: 119430 - DNA, 25 bp, S. pombe
ctccaagctcgcgtctagaaagtat

SEQ ID NO: 119431 - DNA, 25 bp, S. pombe
caaatccgaggatgactccaagctc

SEQ ID NO: 119432 - DNA, 25 bp, S. pombe
gcgtatcatccaaaaactcggtttt

SEQ ID NO: 119433 - DNA, 25 bp, S. pombe
tagactgtcgtcttgatctcaaaac

SEQ ID NO: 119434 - DNA, 25 bp, S. pombe
gtgcctttatgaataactcttcttt

SEQ ID NO: 119435 - DNA, 25 bp, S. pombe
ggcattgttccaacccttcaaaata

SEQ ID NO: 119436 - DNA, 25 bp, S. pombe
tgttctccccaatgccaataacgag

SEQ ID NO: 119437 - DNA, 25 bp, S. pombe
gttgctactgtaaacttagactgtc

SEQ ID NO: 119438 - DNA, 25 bp, S. pombe
acccttcaaaatattgttgctactg

SEQ ID NO: 119439 - DNA, 25 bp, S. pombe
cgtcttgatctcaaaactattgcgc

SEQ ID NO: 119440 - DNA, 25 bp, S. pombe
gctacaaatgagacggcagattccg

SEQ ID NO: 119441 - DNA, 25 bp, S. pombe
cctcgcaagcgagtgcctttatgaa

SEQ ID NO: 119442 - DNA, 25 bp, S. pombe
gaaggtgtatctggcattgttccaa

SEQ ID NO: 119443 - DNA, 25 bp, S. pombe
atggatttcgctttacccaccacgg

SEQ ID NO: 119444 - DNA, 25 bp, S. pombe
tggaaggtttggcttactcccacgg

SEQ ID NO: 119445 - DNA, 25 bp, S. pombe
gtttcccggtttgatttatcgcatg

SEQ ID NO: 119446 - DNA, 25 bp, S. pombe
gttctattgatttttgtttctggta

SEQ ID NO: 119447 - DNA, 25 bp, S. pombe
tccagtattgtctgaatttcgaaaa

SEQ ID NO: 119448 - DNA, 25 bp, S. pombe
tcttatgagcctgagttgtttcccg

SEQ ID NO: 119449 - DNA, 25 bp, S. pombe
taactggtgcgaaagtccgtgagga

SEQ ID NO: 119450 - DNA, 25 bp, S. pombe
tccgtgaggaaatttaccaagcttt

SEQ ID NO: 119451 - DNA, 25 bp, S. pombe
gaagccatttatccagtattgtctg

SEQ ID NO: 119452 - DNA, 25 bp, S. pombe
cccacggtactttctcatcttatga

SEQ ID NO: 119453 - DNA, 25 bp, S. pombe
gcttttgaagccatttatccagtat

SEQ ID NO: 119454 - DNA, 25 bp, S. pombe
gatgttaaatttccaattcgtttgg

SEQ ID NO: 119455 - DNA, 25 bp, S. pombe
tagcttactctatagccaggctgcc

SEQ ID NO: 119456 - DNA, 25 bp, S. pombe
tagtgccaatttctgatgaccatgt

SEQ ID NO: 119457 - DNA, 25 bp, S. pombe
tgggactgggcctcatacgtatgaa

SEQ ID NO: 119458 - DNA, 25 bp, S. pombe
ggccttcccagaactgtaattccgt

SEQ ID NO: 119459 - DNA, 25 bp, S. pombe
gatgagattggctcttctacatgga

SEQ ID NO: 119460 - DNA, 25 bp, S. pombe
aagaagcctcgtggcctttattcaa

SEQ ID NO: 119461 - DNA, 25 bp, S. pombe
gagatcctctttgagatggacattt

SEQ ID NO: 119462 - DNA, 25 bp, S. pombe
gagcatgaatactacaccgagttgg

SEQ ID NO: 119463 - DNA, 25 bp, S. pombe
gaccatgttgtgagaataacccttg

SEQ ID NO: 119464 - DNA, 25 bp, S. pombe
gaggaatttccttgggactgggcct

SEQ ID NO: 119465 - DNA, 25 bp, S. pombe
gcaatcacctttccgttcaatatag

SEQ ID NO: 119466 - DNA, 25 bp, S. pombe
ggagggcaaaacaacttcttagaga

SEQ ID NO: 119467 - DNA, 25 bp, S. pombe
gttccttacagtttagtcgttcgca

SEQ ID NO: 119468 - DNA, 25 bp, S. pombe
gatgaatcgtcagcgaagtcttctg

SEQ ID NO: 119469 - DNA, 25 bp, S. pombe
tgcgacattggactcgaaacgaaat

SEQ ID NO: 119470 - DNA, 25 bp, S. pombe
tgattgctcaaacggaatgctctct

SEQ ID NO: 119471 - DNA, 25 bp, S. pombe
gaaacaatttctcctttcctcaaat

SEQ ID NO: 119472 - DNA, 25 bp, S. pombe
gaacgaggaccttttcgagatttga

SEQ ID NO: 119473 - DNA, 25 bp, S. pombe
gcaaccgcccgaatcaaaagagtca

SEQ ID NO: 119474 - DNA, 25 bp, S. pombe
gaatgctctcttgcccttgatatga

SEQ ID NO: 119475 - DNA, 25 bp, S. pombe
gaatctatggattcgcaggcttaca

SEQ ID NO: 119476 - DNA, 25 bp, S. pombe
gcccttgatatgacctctttgttat

SEQ ID NO: 119477 - DNA, 25 bp, S. pombe
tttttattcaacataccccaacgct

SEQ ID NO: 119478 - DNA, 25 bp, S. pombe
tatatggctatagacgcaaatgcgc

SEQ ID NO: 119479 - DNA, 25 bp, S. pombe
ggaactcgagaattccctatcgata

SEQ ID NO: 119480 - DNA, 25 bp, S. pombe
aacagacttagcatttcgtggagaa

SEQ ID NO: 119481 - DNA, 25 bp, S. pombe
gacatatctttcaaattcatgccca

SEQ ID NO: 119482 - DNA, 25 bp, S. pombe
gaaccggccatttttattcaacata

SEQ ID NO: 119483 - DNA, 25 bp, S. pombe
gacgcagtcagcagccagagttata

SEQ ID NO: 119484 - DNA, 25 bp, S. pombe
caggagtctctggaatttcaaagat

SEQ ID NO: 119485 - DNA, 25 bp, S. pombe
gcaaatgcgcccttaattcttcgtc

SEQ ID NO: 119486 - DNA, 25 bp, S. pombe
atgcgattgcacacattttgttttt

SEQ ID NO: 119487 - DNA, 25 bp, S. pombe
ataccccaacgcttcatggaacaga

SEQ ID NO: 119488 - DNA, 25 bp, S. pombe
tttatccgtcatcgtactcctgaag

SEQ ID NO: 119489 - DNA, 25 bp, S. pombe
gggtaagcctgtttttatccgtcat

SEQ ID NO: 119490 - DNA, 25 bp, S. pombe
gtagatattagcactcttagggatc

SEQ ID NO: 119491 - DNA, 25 bp, S. pombe
ggcgagttggtctgcatctgctgat

SEQ ID NO: 119492 - DNA, 25 bp, S. pombe
ggagctcaagctactgttcatgatt

SEQ ID NO: 119493 - DNA, 25 bp, S. pombe
gttcatgatttcttggcgagttggt

SEQ ID NO: 119494 - DNA, 25 bp, S. pombe
gaaatccaagaagccaattctgtag

SEQ ID NO: 119495 - DNA, 25 bp, S. pombe
gaaagaaccttgtcgtcaaatggca

SEQ ID NO: 119496 - DNA, 25 bp, S. pombe
ctgctgatgtgttggctatgtcgaa

SEQ ID NO: 119497 - DNA, 25 bp, S. pombe
cttacagccgctggagctcaagcta

SEQ ID NO: 119498 - DNA, 25 bp, S. pombe
gaaggccgaggttgatttgtcgaaa

SEQ ID NO: 119499 - DNA, 25 bp, S. pombe
gttctcgtgttatatcttatgccat

SEQ ID NO: 119500 - DNA, 25 bp, S. pombe
actgcttcgtcgttgaagggctcaa

SEQ ID NO: 119501 - DNA, 25 bp, S. pombe
aagtcgttagcatcttcgttaagac

SEQ ID NO: 119502 - DNA, 25 bp, S. pombe
aagggctcaatgatgaccatcccaa

SEQ ID NO: 119503 - DNA, 25 bp, S. pombe
tgactctccggaaatgccagacttt

SEQ ID NO: 119504 - DNA, 25 bp, S. pombe
taagacggttgcttcccgtttcaag

SEQ ID NO: 119505 - DNA, 25 bp, S. pombe
gaccatcccaaaatttacctctatt

SEQ ID NO: 119506 - DNA, 25 bp, S. pombe
gctggccaagcaatttatttctaag

SEQ ID NO: 119507 - DNA, 25 bp, S. pombe
attcgtacatatactgactctccgg

SEQ ID NO: 119508 - DNA, 25 bp, S. pombe
atgccagacttttcggagtatcaaa

SEQ ID NO: 119509 - DNA, 25 bp, S. pombe
agagcactggtgatcgttctcgtgt

SEQ ID NO: 119510 - DNA, 25 bp, S. pombe
tatgatatctctggtcgtattcgcc

SEQ ID NO: 119511 - DNA, 25 bp, S. pombe
ggcgattcctgcttatacgtttgaa

SEQ ID NO: 119512 - DNA, 25 bp, S. pombe
gattggtgtctgtactcatcttggt

SEQ ID NO: 119513 - DNA, 25 bp, S. pombe
tctgaccgtgttcaaaaacccgagt

SEQ ID NO: 119514 - DNA, 25 bp, S. pombe
aaacccgagtggcttgttatgattg

SEQ ID NO: 119515 - DNA, 25 bp, S. pombe
acccattggcgaagctggtgactat

SEQ ID NO: 119516 - DNA, 25 bp, S. pombe
tgcacctcttaacttggcgattcct

SEQ ID NO: 119517 - DNA, 25 bp, S. pombe
tcaagcggactctgaccgtgttcaa

SEQ ID NO: 119518 - DNA, 25 bp, S. pombe
cccttgtcacggttctcattatgat

SEQ ID NO: 119519 - DNA, 25 bp, S. pombe
atcttggttgtgtacccattggcga

SEQ ID NO: 119520 - DNA, 25 bp, S. pombe
atggcggatggttctgcccttgtca

SEQ ID NO: 119521 - DNA, 25 bp, S. pombe
gtggtgccaagcgtgtcatcatctc

SEQ ID NO: 119522 - DNA, 25 bp, S. pombe
ggtcgtggcgccagcgccaacatca

SEQ ID NO: 119523 - DNA, 25 bp, S. pombe
tgccacccaaaagaccgttgacggt

SEQ ID NO: 119524 - DNA, 25 bp, S. pombe
aactgtttggctccccttgccaagg

SEQ ID NO: 119525 - DNA, 25 bp, S. pombe
aagcgtgtcatcatctctgctcctt

SEQ ID NO: 119526 - DNA, 25 bp, S. pombe
aaggactggcgtggtggtcgtggcg

SEQ ID NO: 119527 - DNA, 25 bp, S. pombe
tcatcatctctgctccttccaagga

SEQ ID NO: 119528 - DNA, 25 bp, S. pombe
tcttgcaccaccaactgtttggctc

SEQ ID NO: 119529 - DNA, 25 bp, S. pombe
cttgccaaggtcatcaacgacacct

SEQ ID NO: 119530 - DNA, 25 bp, S. pombe
actggtgccgccaaggccgtcggta

SEQ ID NO: 119531 - DNA, 25 bp, S. pombe
aggtcatcaacgacaccttcggtat

SEQ ID NO: 119532 - DNA, 25 bp, S. pombe
ttccaaggatgctcccatgttcgtc

SEQ ID NO: 119533 - DNA, 25 bp, S. pombe
gtcggtgttaacttggagaagttca

SEQ ID NO: 119534 - DNA, 25 bp, S. pombe
gtcgtcggtgttaacttggagaagt

SEQ ID NO: 119535 - DNA, 25 bp, S. pombe
tgttcgtcgtcggtgttaacttgga

SEQ ID NO: 119536 - DNA, 25 bp, S. pombe
gatgctcccatgttcgtcgtcggtg

SEQ ID NO: 119537 - DNA, 25 bp, S. pombe
aaggatgctcccatgttcgtcgtcg

SEQ ID NO: 119538 - DNA, 25 bp, S. pombe
tcccatgttcgtcgtcggtgttaac

SEQ ID NO: 119539 - DNA, 25 bp, S. pombe
ctccttccaaggatgctcccatgtt

SEQ ID NO: 119540 - DNA, 25 bp, S. pombe
catgttcgtcgtcggtgttaacttg

SEQ ID NO: 119541 - DNA, 25 bp, S. pombe
gctcccatgttcgtcgtcggtgtta

SEQ ID NO: 119542 - DNA, 25 bp, S. pombe
ttcgtcgtcggtgttaacttggaga

SEQ ID NO: 119543 - DNA, 25 bp, S. pombe
ttcactaccaaggagactgcctctg

SEQ ID NO: 119544 - DNA, 25 bp, S. pombe
ttgtcgctgtcaacgatcctttcat

SEQ ID NO: 119545 - DNA, 25 bp, S. pombe
gtggcaagcttgtcatcgacggtca

SEQ ID NO: 119546 - DNA, 25 bp, S. pombe
gtaacgccatcctcactggcaagat

SEQ ID NO: 119547 - DNA, 25 bp, S. pombe
tgtcatcgacggtcactccatcgat

SEQ ID NO: 119548 - DNA, 25 bp, S. pombe
ggcaagatccaagttgtcgctgtca

SEQ ID NO: 119549 - DNA, 25 bp, S. pombe
tgctgagtacgttattgagtccact

SEQ ID NO: 119550 - DNA, 25 bp, S. pombe
cgttgagaccaagggtggcaagctt

SEQ ID NO: 119551 - DNA, 25 bp, S. pombe
gctttgagggctccgttgagaccaa

SEQ ID NO: 119552 - DNA, 25 bp, S. pombe
attgagtccactggtgtcttcacta

SEQ ID NO: 119553 - DNA, 25 bp, S. pombe
atcgatcttgactacatggcatata

SEQ ID NO: 119554 - DNA, 25 bp, S. pombe
ttgaccgtcaagttggccaagccta

SEQ ID NO: 119555 - DNA, 25 bp, S. pombe
gtatccaactttctcctcaattcgt

SEQ ID NO: 119556 - DNA, 25 bp, S. pombe
tggccaagcctaccaactacgagga

SEQ ID NO: 119557 - DNA, 25 bp, S. pombe
gtttccgttgttgacttgaccgtca

SEQ ID NO: 119558 - DNA, 25 bp, S. pombe
aattcgtcaagctcgtctcttggta

SEQ ID NO: 119559 - DNA, 25 bp, S. pombe
taagcttaccggtatggctttccgt

SEQ ID NO: 119560 - DNA, 25 bp, S. pombe
cttcgatgcctctgccggtatccaa

SEQ ID NO: 119561 - DNA, 25 bp, S. pombe
ctaccaactacgaggacatcaaggc

SEQ ID NO: 119562 - DNA, 25 bp, S. pombe
ccatgaagggtgtgttgggttacac

SEQ ID NO: 119563 - DNA, 25 bp, S. pombe
cccgatgtttccgttgttgacttga

SEQ ID NO: 119564 - DNA, 25 bp, S. pombe
gctcgtctcttggtacgataacgaa

SEQ ID NO: 119565 - DNA, 25 bp, S. pombe
gtcgctgagccattagagtctcgca

SEQ ID NO: 119566 - DNA, 25 bp, S. pombe
ggctgctggccctattttatataaa

SEQ ID NO: 119567 - DNA, 25 bp, S. pombe
gttgcaggccactaacatgacttat

SEQ ID NO: 119568 - DNA, 25 bp, S. pombe
gatgaatatttgtctccccaaagcc

SEQ ID NO: 119569 - DNA, 25 bp, S. pombe
tcgtggtaatccaacctcttatatt

SEQ ID NO: 119570 - DNA, 25 bp, S. pombe
gacaaattgggttttccagcgcaag

SEQ ID NO: 119571 - DNA, 25 bp, S. pombe
gacacaacctattcttcgtggtaat

SEQ ID NO: 119572 - DNA, 25 bp, S. pombe
caaagaatccttgggctgctggcac

SEQ ID NO: 119573 - DNA, 25 bp, S. pombe
gctggcactcaactgtttttggtca

SEQ ID NO: 119574 - DNA, 25 bp, S. pombe
atcatttctgatgagacccgggctg

SEQ ID NO: 119575 - DNA, 25 bp, S. pombe
agcaccggcgaacgtgttggtctta

SEQ ID NO: 119576 - DNA, 25 bp, S. pombe
ttctcccctaaatctcttctagaat

SEQ ID NO: 119577 - DNA, 25 bp, S. pombe
gtacaagcagctcgtcagacggttt

SEQ ID NO: 119578 - DNA, 25 bp, S. pombe
ggtgaacgtctttacgacaacttga

SEQ ID NO: 119579 - DNA, 25 bp, S. pombe
ggcccttacatggtcgcttttagta

SEQ ID NO: 119580 - DNA, 25 bp, S. pombe
ggatatgtttctggccgaacgtcaa

SEQ ID NO: 119581 - DNA, 25 bp, S. pombe
acttgtttgttgttgcaggctctca

SEQ ID NO: 119582 - DNA, 25 bp, S. pombe
taatcacgctgaaggttctgacgat

SEQ ID NO: 119583 - DNA, 25 bp, S. pombe
gaacgtcaatctgtcgttgttgatc

SEQ ID NO: 119584 - DNA, 25 bp, S. pombe
cattgtgtattgctttggcccttac

SEQ ID NO: 119585 - DNA, 25 bp, S. pombe
agacggttttggctgttgccgacca

SEQ ID NO: 119586 - DNA, 25 bp, S. pombe
aggctctcaacttcccgaaggaata

SEQ ID NO: 119587 - DNA, 25 bp, S. pombe
tatcgtgtcaatctcgttccagttc

SEQ ID NO: 119588 - DNA, 25 bp, S. pombe
gttccagttccatcggatagtcaaa

SEQ ID NO: 119589 - DNA, 25 bp, S. pombe
actatgcctcttgtttctctgtatt

SEQ ID NO: 119590 - DNA, 25 bp, S. pombe
gaagacggtcagcaaactccatacg

SEQ ID NO: 119591 - DNA, 25 bp, S. pombe
aatcgaatacaagcgtcctggcctt

SEQ ID NO: 119592 - DNA, 25 bp, S. pombe
tgaagctgtgttagttgcgcctgac

SEQ ID NO: 119593 - DNA, 25 bp, S. pombe
tcctggccttactcctattgaagag

SEQ ID NO: 119594 - DNA, 25 bp, S. pombe
gaccactacggcgactttacattta

SEQ ID NO: 119595 - DNA, 25 bp, S. pombe
gagaaatctacctttacacttcgtc

SEQ ID NO: 119596 - DNA, 25 bp, S. pombe
ctgtcgttccttctgccaaaaaaca

SEQ ID NO: 119597 - DNA, 25 bp, S. pombe
atgttggacccttactatcgtgtca

SEQ ID NO: 119598 - DNA, 25 bp, S. pombe
gtgacttgactgactaccttatgaa

SEQ ID NO: 119599 - DNA, 25 bp, S. pombe
gtaccactggtatcgtcttggactc

SEQ ID NO: 119600 - DNA, 25 bp, S. pombe
aacttcaaactgctgctcaatcttc

SEQ ID NO: 119601 - DNA, 25 bp, S. pombe
aatcttatgagcttcctgatggtca

SEQ ID NO: 119602 - DNA, 25 bp, S. pombe
aatgcacctgccttttatgttgcta

SEQ ID NO: 119603 - DNA, 25 bp, S. pombe
aagctgttttgtctttgtatgcctc

SEQ ID NO: 119604 - DNA, 25 bp, S. pombe
gactctggtgatggtgttacccaca

SEQ ID NO: 119605 - DNA, 25 bp, S. pombe
gaaactttgctacgtcgctttggac

SEQ ID NO: 119606 - DNA, 25 bp, S. pombe
atgctatcatgcgtcttgatctcgc

SEQ ID NO: 119607 - DNA, 25 bp, S. pombe
agcgtggttatactttctctactac

SEQ ID NO: 119608 - DNA, 25 bp, S. pombe
agggttatgctcttcctcatgctat

SEQ ID NO: 119609 - DNA, 25 bp, S. pombe
tagaccccgtcaccatggtattatg

SEQ ID NO: 119610 - DNA, 25 bp, S. pombe
ttgaccttgaagtaccccattgagc

SEQ ID NO: 119611 - DNA, 25 bp, S. pombe
tgttgactgaggctcctttgaaccc

SEQ ID NO: 119612 - DNA, 25 bp, S. pombe
tgtattcccctcgattgtcggtaga

SEQ ID NO: 119613 - DNA, 25 bp, S. pombe
ggtttcgctggagatgatgccccta

SEQ ID NO: 119614 - DNA, 25 bp, S. pombe
acgagcttcgtgttgctcctgagga

SEQ ID NO: 119615 - DNA, 25 bp, S. pombe
gaaccccaaatccaaccgtgagaag

SEQ ID NO: 119616 - DNA, 25 bp, S. pombe
ctggtatgtgcaaagccggtttcgc

SEQ ID NO: 119617 - DNA, 25 bp, S. pombe
gcatcacactttctacaacgagctt

SEQ ID NO: 119618 - DNA, 25 bp, S. pombe
aggagcacccttgcttgttgactga

SEQ ID NO: 119619 - DNA, 25 bp, S. pombe
agatgatgcccctagagctgtattc

SEQ ID NO: 119620 - DNA, 25 bp, S. pombe
ttgctcctagctccatgaaggtcaa

SEQ ID NO: 119621 - DNA, 25 bp, S. pombe
gtggtaccactatgtatcccggtat

SEQ ID NO: 119622 - DNA, 25 bp, S. pombe
gattggtggatccattcttgcttct

SEQ ID NO: 119623 - DNA, 25 bp, S. pombe
acgccggtattcatgaggctactta

SEQ ID NO: 119624 - DNA, 25 bp, S. pombe
aacgttgttatgtctggtggtacca

SEQ ID NO: 119625 - DNA, 25 bp, S. pombe
aaggagattcaagcccttgctccta

SEQ ID NO: 119626 - DNA, 25 bp, S. pombe
gagagcggacctggtatcgtttacc

SEQ ID NO: 119627 - DNA, 25 bp, S. pombe
cagctttgggtcttgaaaacgccgg

SEQ ID NO: 119628 - DNA, 25 bp, S. pombe
cttctctttctactttccaacagat

SEQ ID NO: 119629 - DNA, 25 bp, S. pombe
aggctacttacaactctatcatgaa

SEQ ID NO: 119630 - DNA, 25 bp, S. pombe
aggtcaagattgttgctcctcctga

SEQ ID NO: 119631 - DNA, 25 bp, S. pombe
tttcagcaacggatctcttggctct

SEQ ID NO: 119632 - DNA, 25 bp, S. pombe
tgggttctaccaaaggcatgcctgt

SEQ ID NO: 119633 - DNA, 25 bp, S. pombe
acattgcgcctttgggttctaccaa

SEQ ID NO: 119634 - DNA, 25 bp, S. pombe
aaggcatgcctgtttgagtgtcatt

SEQ ID NO: 119635 - DNA, 25 bp, S. pombe
taaaactttcagcaacggatctctt

SEQ ID NO: 119636 - DNA, 25 bp, S. pombe
tcgaatctttgaacgcacattgcgc

SEQ ID NO: 119637 - DNA, 25 bp, S. pombe
tcttggctctcgcatcgatgaagaa

SEQ ID NO: 119638 - DNA, 25 bp, S. pombe
ctctcgcatcgatgaagaacgcagc

SEQ ID NO: 119639 - DNA, 25 bp, S. pombe
gaattccgtgaatcatcgaatcttt

SEQ ID NO: 119640 - DNA, 25 bp, S. pombe
gcgatacgtaatgtgaattgcagaa

SEQ ID NO: 119641 - DNA, 25 bp, S. pombe
gaacgcagcgaaatgcgatacgtaa

SEQ ID NO: 119642 - DNA, 25 bp, S. pombe
ttggaagagttcagcgcctcatgct

SEQ ID NO: 119643 - DNA, 25 bp, S. pombe
tacgttgggccttggaacctgaacg

SEQ ID NO: 119644 - DNA, 25 bp, S. pombe
tcgacggcccttgaaaatccaacgg

SEQ ID NO: 119645 - DNA, 25 bp, S. pombe
gggaagctccgtatgaaagttgcac

SEQ ID NO: 119646 - DNA, 25 bp, S. pombe
ggaccttcgggtcttgttttcacat

SEQ ID NO: 119647 - DNA, 25 bp, S. pombe
ggagccctgggaagagttctctttt

SEQ ID NO: 119648 - DNA, 25 bp, S. pombe
gatttttcgtgcctcctatcgaaag

SEQ ID NO: 119649 - DNA, 25 bp, S. pombe
gttttcacatctggtcgtactcata

SEQ ID NO: 119650 - DNA, 25 bp, S. pombe
aaccattgaactaccctgaaatcgg

SEQ ID NO: 119651 - DNA, 25 bp, S. pombe
gaacagcctctagtgcagatcttgg

SEQ ID NO: 119652 - DNA, 25 bp, S. pombe
aggtctccaaggtgaacagcctcta

SEQ ID NO: 119653 - DNA, 25 bp, S. pombe
ggaaatcagtcttacctgggtgaga

SEQ ID NO: 119654 - DNA, 25 bp, S. pombe
tggtaggtcagcatcagttttcggg

SEQ ID NO: 119655 - DNA, 25 bp, S. pombe
ggagtgtttatagcccttgttgtaa

SEQ ID NO: 119656 - DNA, 25 bp, S. pombe
tgagatcagtagtctcttcgcgaga

SEQ ID NO: 119657 - DNA, 25 bp, S. pombe
gacgatcggtctaagttccttggaa

SEQ ID NO: 119658 - DNA, 25 bp, S. pombe
gaagctgctttgagtgtagacgatc

SEQ ID NO: 119659 - DNA, 25 bp, S. pombe
gactatgcactctgaacctgtggta

SEQ ID NO: 119660 - DNA, 25 bp, S. pombe
gaaccccgtctttggtcgattggat

SEQ ID NO: 119661 - DNA, 25 bp, S. pombe
catttcttttgttgtccgagttgta

SEQ ID NO: 119662 - DNA, 25 bp, S. pombe
caggtaggactacgcgctgaactta

SEQ ID NO: 119663 - DNA, 25 bp, S. pombe
ataaccatgattccctcagtaacgg

SEQ ID NO: 119664 - DNA, 25 bp, S. pombe
gtgcggaatcgaatccattgcatac

SEQ ID NO: 119665 - DNA, 25 bp, S. pombe
tgtggcagccaagcgttcatagcga

SEQ ID NO: 119666 - DNA, 25 bp, S. pombe
gttcctactctcctgtatcgtagaa

SEQ ID NO: 119667 - DNA, 25 bp, S. pombe
aaagcgacgattttttggtccgcat

SEQ ID NO: 119668 - DNA, 25 bp, S. pombe
aagcgttggattgttcacccactaa

SEQ ID NO: 119669 - DNA, 25 bp, S. pombe
ctaagccagaatccgtgccagaaag

SEQ ID NO: 119670 - DNA, 25 bp, S. pombe
caggttagttttaccctactgatga

SEQ ID NO: 119671 - DNA, 25 bp, S. pombe
gccttgttgttacgatctgctgaga

SEQ ID NO: 119672 - DNA, 25 bp, S. pombe
gctttttgattcttcgatgtcggct

SEQ ID NO: 119673 - DNA, 25 bp, S. pombe
gcggagctatcatctgccggataac

SEQ ID NO: 119674 - DNA, 25 bp, S. pombe
agatcattggtatttgcggctgcct

SEQ ID NO: 119675 - DNA, 25 bp, S. pombe
tagttgaactttgagcctggtcgac

SEQ ID NO: 119676 - DNA, 25 bp, S. pombe
tagggatcgggcaatgtttcattta

SEQ ID NO: 119677 - DNA, 25 bp, S. pombe
ttggtttctaggaccgccgtaatga

SEQ ID NO: 119678 - DNA, 25 bp, S. pombe
gtgtggttctattttgttggtttct

SEQ ID NO: 119679 - DNA, 25 bp, S. pombe
gggcattcgtattcaattgtcagag

SEQ ID NO: 119680 - DNA, 25 bp, S. pombe
gataccgtcgtagtcttaaccataa

SEQ ID NO: 119681 - DNA, 25 bp, S. pombe
gtttcatttatcgacttgctcggca

SEQ ID NO: 119682 - DNA, 25 bp, S. pombe
aaggcgtgtttactggtcatgaccg

SEQ ID NO: 119683 - DNA, 25 bp, S. pombe
taaccttctggcaaactactcatgt

SEQ ID NO: 119684 - DNA, 25 bp, S. pombe
cacaatggagtggagcctgcggctt

SEQ ID NO: 119685 - DNA, 25 bp, S. pombe
agcctgcggcttaatttgactcaac

SEQ ID NO: 119686 - DNA, 25 bp, S. pombe
ttgcgccggcgatggttcattcaaa

SEQ ID NO: 119687 - DNA, 25 bp, S. pombe
gtacctcaactacttggataaccgt

SEQ ID NO: 119688 - DNA, 25 bp, S. pombe
ggttcattcaaatttctgccctatc

SEQ ID NO: 119689 - DNA, 25 bp, S. pombe
aacttttcgaatcgcatggccttgc

SEQ ID NO: 119690 - DNA, 25 bp, S. pombe
aataacaatgcagggccctttcggg

SEQ ID NO: 119691 - DNA, 25 bp, S. pombe
tctgccctatcaactttcgatggta

SEQ ID NO: 119692 - DNA, 25 bp, S. pombe
gagaaacggctaccacatccaagga

SEQ ID NO: 119693 - DNA, 25 bp, S. pombe
gccagtagtcatatgcttgtctcaa

SEQ ID NO: 119694 - DNA, 25 bp, S. pombe
gcagcaggcgcgcaaattacccaat

SEQ ID NO: 119695 - DNA, 25 bp, S. pombe
ataaccgtggtaattctagagctaa

SEQ ID NO: 119696 - DNA, 25 bp, S. pombe
aggatagaggcctaccatggtttta

SEQ ID NO: 119697 - DNA, 25 bp, S. pombe
ttgattttttatccttggccggaag

SEQ ID NO: 119698 - DNA, 25 bp, S. pombe
gtcgctactaccgattgaatggctt

SEQ ID NO: 119699 - DNA, 25 bp, S. pombe
ggaattcctagtaagcgcaagtcat

SEQ ID NO: 119700 - DNA, 25 bp, S. pombe
ggattggcttgtttctgctggcaac

SEQ ID NO: 119701 - DNA, 25 bp, S. pombe
aacaggtctgtgatgcccttagatg

SEQ ID NO: 119702 - DNA, 25 bp, S. pombe
aatcttgttaaactccgtcgtgctg

SEQ ID NO: 119703 - DNA, 25 bp, S. pombe
gagagctctttcttgattctatggg

SEQ ID NO: 119704 - DNA, 25 bp, S. pombe
gaacgagaccttaacctgctaaata

SEQ ID NO: 119705 - DNA, 25 bp, S. pombe
catggccgttcttagttggtggagt

SEQ ID NO: 119706 - DNA, 25 bp, S. pombe
atcagcttgcgttgaatacgtccct

SEQ ID NO: 119707 - DNA, 25 bp, S. pombe
gctacactgacggagccaacgagtt

SEQ ID NO: 119708 - DNA, 25 bp, S. cerevisiae
ttcgccctcctcagaagagctagtg

SEQ ID NO: 119709 - DNA, 25 bp, S. cerevisiae
gtggtttcttctaaccatcttctga

SEQ ID NO: 119710 - DNA, 25 bp, S. cerevisiae
gttatgacgaagagccctacaaaat

SEQ ID NO: 119711 - DNA, 25 bp, S. cerevisiae
gttcattcacatgcggatggtacta

SEQ ID NO: 119712 - DNA, 25 bp, S. cerevisiae
aaaagtgtgcatgcggttcattcac

SEQ ID NO: 119713 - DNA, 25 bp, S. cerevisiae
aagaacatcctttactgagtccaaa

SEQ ID NO: 119714 - DNA, 25 bp, S. cerevisiae
gaaaatcgtgaacaaatcgtcccaa

SEQ ID NO: 119715 - DNA, 25 bp, S. cerevisiae
gaccagcggatctcaaggctttctt

SEQ ID NO: 119716 - DNA, 25 bp, S. cerevisiae
caaatgcaactcttggaccagcgga

SEQ ID NO: 119717 - DNA, 25 bp, S. cerevisiae
gctcgtttagtatggatcggcagta

SEQ ID NO: 119718 - DNA, 25 bp, S. cerevisiae
aggctttcttgtagttggtttccag

SEQ ID NO: 119719 - DNA, 25 bp, S. cerevisiae
tacgaccaatctacggaacctttag

SEQ ID NO: 119720 - DNA, 25 bp, S. cerevisiae
ttaggtatctatccaagtccaaaag

SEQ ID NO: 119721 - DNA, 25 bp, S. cerevisiae
tttttcttttgtatccttctgcagg

SEQ ID NO: 119722 - DNA, 25 bp, S. cerevisiae
tgtgggcacacaaacttcaagaacg

SEQ ID NO: 119723 - DNA, 25 bp, S. cerevisiae
acatcatcgtttttcctaccaaagg

SEQ ID NO: 119724 - DNA, 25 bp, S. cerevisiae
aacagtacttccactactgtggatt

SEQ ID NO: 119725 - DNA, 25 bp, S. cerevisiae
gaacgcttgttctttacgaccaatc

SEQ ID NO: 119726 - DNA, 25 bp, S. cerevisiae
cgagacaaatcccagttaagcagtt

SEQ ID NO: 119727 - DNA, 25 bp, S. cerevisiae
gcaggccattttcgttgtgggcaca

SEQ ID NO: 119728 - DNA, 25 bp, S. cerevisiae
atgcatgagttctccaggtgctgtt

SEQ ID NO: 119729 - DNA, 25 bp, S. cerevisiae
aggtgctgttccgaataccattcgt

SEQ ID NO: 119730 - DNA, 25 bp, S. cerevisiae
ttacgacttcctctgttggcaagaa

SEQ ID NO: 119731 - DNA, 25 bp, S. cerevisiae
gtaagattggcctgtcgttcactac

SEQ ID NO: 119732 - DNA, 25 bp, S. cerevisiae
gggtttatattagcgccatttgtgg

SEQ ID NO: 119733 - DNA, 25 bp, S. cerevisiae
tgtttacattcctcactgactatcg

SEQ ID NO: 119734 - DNA, 25 bp, S. cerevisiae
tactaccgtctaacattgtcgccaa

SEQ ID NO: 119735 - DNA, 25 bp, S. cerevisiae
gaaactcagtattacaccaccggtg

SEQ ID NO: 119736 - DNA, 25 bp, S. cerevisiae
cagaccgccatggagtgtttacatt

SEQ ID NO: 119737 - DNA, 25 bp, S. cerevisiae
ctatccgtcaccttgctaatgatga

SEQ ID NO: 119738 - DNA, 25 bp, S. cerevisiae
ccatttgtggcgtcattgttgcgtg

SEQ ID NO: 119739 - DNA, 25 bp, S. cerevisiae
gaatggctaccacatatcgctgatg

SEQ ID NO: 119740 - DNA, 25 bp, S. cerevisiae
agacaagtggatccgtactaccgtc

SEQ ID NO: 119741 - DNA, 25 bp, S. cerevisiae
tagaggccttttgatgttagcagaa

SEQ ID NO: 119742 - DNA, 25 bp, S. cerevisiae
tgggcccaggtattgttagcggttt

SEQ ID NO: 119743 - DNA, 25 bp, S. cerevisiae
actgttgacattgcgaagagcgaca

SEQ ID NO: 119744 - DNA, 25 bp, S. cerevisiae
aagggctccctagctactggagaat

SEQ ID NO: 119745 - DNA, 25 bp, S. cerevisiae
tacagtcaaattgcagtactctgcg

SEQ ID NO: 119746 - DNA, 25 bp, S. cerevisiae
gacattacgaatgcacacggtgtgg

SEQ ID NO: 119747 - DNA, 25 bp, S. cerevisiae
gaaaatttgctgacattggtaatac

SEQ ID NO: 119748 - DNA, 25 bp, S. cerevisiae
atactaagggtactgttgacattgc

SEQ ID NO: 119749 - DNA, 25 bp, S. cerevisiae
agcaggcggcggaagaagtaacaaa

SEQ ID NO: 119750 - DNA, 25 bp, S. cerevisiae
agtactctgcgggtgtatacagaat

SEQ ID NO: 119751 - DNA, 25 bp, S. cerevisiae
agaattgtcatgcaagggctcccta

SEQ ID NO: 119752 - DNA, 25 bp, S. cerevisiae
tataaggaacgtgctgctactcatc

SEQ ID NO: 119753 - DNA, 25 bp, S. cerevisiae
ggcattatccgccaagtacaatttt

SEQ ID NO: 119754 - DNA, 25 bp, S. cerevisiae
tggagggcacagttaagccgctaaa

SEQ ID NO: 119755 - DNA, 25 bp, S. cerevisiae
tggatgttcgtaccaccaaggaatt

SEQ ID NO: 119756 - DNA, 25 bp, S. cerevisiae
aacacatgtggatatcttgactgat

SEQ ID NO: 119757 - DNA, 25 bp, S. cerevisiae
aacttgtgtgcttcattggatgttc

SEQ ID NO: 119758 - DNA, 25 bp, S. cerevisiae
tgctactcatcctagtcctgttgct

SEQ ID NO: 119759 - DNA, 25 bp, S. cerevisiae
gagttagttgaagcattaggtccca

SEQ ID NO: 119760 - DNA, 25 bp, S. cerevisiae
cttgactgatttttccatggagggc

SEQ ID NO: 119761 - DNA, 25 bp, S. cerevisiae
agccgctaaaggcattatccgccaa

SEQ ID NO: 119762 - DNA, 25 bp, S. cerevisiae
agtcctgttgctgccaagctattta

SEQ ID NO: 119763 - DNA, 25 bp, S. cerevisiae
ggaagaggactatttgcaaagggaa

SEQ ID NO: 119764 - DNA, 25 bp, S. cerevisiae
gtggtctctacaggatctgacatta

SEQ ID NO: 119765 - DNA, 25 bp, S. cerevisiae
ggtgaacgttacagaaaagcaggct

SEQ ID NO: 119766 - DNA, 25 bp, S. cerevisiae
acaagggagacgcattgggtcaaca

SEQ ID NO: 119767 - DNA, 25 bp, S. cerevisiae
acccggtgtgggtttagatgacaag

SEQ ID NO: 119768 - DNA, 25 bp, S. cerevisiae
aaccgtggatgatgtggtctctaca

SEQ ID NO: 119769 - DNA, 25 bp, S. cerevisiae
attggttgattatgacacccggtgt

SEQ ID NO: 119770 - DNA, 25 bp, S. cerevisiae
atatttgagaagatgcggccagcaa

SEQ ID NO: 119771 - DNA, 25 bp, S. cerevisiae
atcggctttattgctcaaagagaca

SEQ ID NO: 119772 - DNA, 25 bp, S. cerevisiae
gggtcaacagtatagaaccgtggat

SEQ ID NO: 119773 - DNA, 25 bp, S. cerevisiae
agcaggctgggaagcatatttgaga

SEQ ID NO: 119774 - DNA, 25 bp, S. cerevisiae
ttgaagaaggtttgatgaccactgt

SEQ ID NO: 119775 - DNA, 25 bp, S. cerevisiae
ggtccatcccacaaggactggagag

SEQ ID NO: 119776 - DNA, 25 bp, S. cerevisiae
gtggtagaaccgcttccggtaacat

SEQ ID NO: 119777 - DNA, 25 bp, S. cerevisiae
tgtaccaccaactgtttggctccat

SEQ ID NO: 119778 - DNA, 25 bp, S. cerevisiae
actggagaggtggtagaaccgcttc

SEQ ID NO: 119779 - DNA, 25 bp, S. cerevisiae
aacgcttcttgtaccaccaactgtt

SEQ ID NO: 119780 - DNA, 25 bp, S. cerevisiae
tcaacgatgctttcggtattgaaga

SEQ ID NO: 119781 - DNA, 25 bp, S. cerevisiae
cattggccaaggttatcaacgatgc

SEQ ID NO: 119782 - DNA, 25 bp, S. cerevisiae
caactgtttggctccattggccaag

SEQ ID NO: 119783 - DNA, 25 bp, S. cerevisiae
ctaaggctgtcggtaaggtcttgcc

SEQ ID NO: 119784 - DNA, 25 bp, S. cerevisiae
gctgctaaggctgtcggtaaggtct

SEQ ID NO: 119785 - DNA, 25 bp, S. cerevisiae
gttaaccacactaaatacactccag

SEQ ID NO: 119786 - DNA, 25 bp, S. cerevisiae
gtttgttgttggtgttaaccacact

SEQ ID NO: 119787 - DNA, 25 bp, S. cerevisiae
gttgttggtgttaaccacactaaat

SEQ ID NO: 119788 - DNA, 25 bp, S. cerevisiae
acaagaagattgtctccaacgcttc

SEQ ID NO: 119789 - DNA, 25 bp, S. cerevisiae
aatacactccagacaagaagattgt

SEQ ID NO: 119790 - DNA, 25 bp, S. cerevisiae
tctgctccaatgtttgttgttggtg

SEQ ID NO: 119791 - DNA, 25 bp, S. cerevisiae
tcttctgctccaatgtttgttgttg

SEQ ID NO: 119792 - DNA, 25 bp, S. cerevisiae
cttcttctgctccaatgtttgttgt

SEQ ID NO: 119793 - DNA, 25 bp, S. cerevisiae
cactaaatacactccagacaagaag

SEQ ID NO: 119794 - DNA, 25 bp, S. cerevisiae
caatgtttgttgttggtgttaacca

SEQ ID NO: 119795 - DNA, 25 bp, S. cerevisiae
accacactaaatacactccagacaa

SEQ ID NO: 119796 - DNA, 25 bp, S. cerevisiae
tatctctaacgattatgctgcttac

SEQ ID NO: 119797 - DNA, 25 bp, S. cerevisiae
gtcaacgatccatttatctctaacg

SEQ ID NO: 119798 - DNA, 25 bp, S. cerevisiae
gtcaagatcgctacctaccaagaaa

SEQ ID NO: 119799 - DNA, 25 bp, S. cerevisiae
ggttctctaaagatcgatgtcgctg

SEQ ID NO: 119800 - DNA, 25 bp, S. cerevisiae
ggtcaagtacgattctactcatggt

SEQ ID NO: 119801 - DNA, 25 bp, S. cerevisiae
gatgtcgctgttgactccactggtg

SEQ ID NO: 119802 - DNA, 25 bp, S. cerevisiae
gattatgctgcttacatggtcaagt

SEQ ID NO: 119803 - DNA, 25 bp, S. cerevisiae
acaagggtactgtttcccatgacga

SEQ ID NO: 119804 - DNA, 25 bp, S. cerevisiae
ccatgacgacaagcacatcatcatt

SEQ ID NO: 119805 - DNA, 25 bp, S. cerevisiae
attgatggtgtcaagatcgctacct

SEQ ID NO: 119806 - DNA, 25 bp, S. cerevisiae
attggtcttgagattggctttgcaa

SEQ ID NO: 119807 - DNA, 25 bp, S. cerevisiae
tgaaggtccaatgaagggtgttttg

SEQ ID NO: 119808 - DNA, 25 bp, S. cerevisiae
gatcgaatatgttgccaaggcttaa

SEQ ID NO: 119809 - DNA, 25 bp, S. cerevisiae
gttgacttgatcgaatatgttgcca

SEQ ID NO: 119810 - DNA, 25 bp, S. cerevisiae
actccgccagagttgttgacttgat

SEQ ID NO: 119811 - DNA, 25 bp, S. cerevisiae
tgatttcttgggtgacactcacgct

SEQ ID NO: 119812 - DNA, 25 bp, S. cerevisiae
tgccgttgtctcctctgatttcttg

SEQ ID NO: 119813 - DNA, 25 bp, S. cerevisiae
ctgtcaagttggaaaaggaagctac

SEQ ID NO: 119814 - DNA, 25 bp, S. cerevisiae
cggttactccgccagagttgttgac

SEQ ID NO: 119815 - DNA, 25 bp, S. cerevisiae
gaagatgccgttgtctcctctgatt

SEQ ID NO: 119816 - DNA, 25 bp, S. cerevisiae
gctgccgctgaaggtccaatgaagg

SEQ ID NO: 119817 - DNA, 25 bp, S. cerevisiae
aggaagctacttacgaccaaatcaa

SEQ ID NO: 119818 - DNA, 25 bp, S. cerevisiae
taccccacagtagttcagtgttcaa

SEQ ID NO: 119819 - DNA, 25 bp, S. cerevisiae
gtatggttacgaagactctggatct

SEQ ID NO: 119820 - DNA, 25 bp, S. cerevisiae
aaatttggatttgataccccacagt

SEQ ID NO: 119821 - DNA, 25 bp, S. cerevisiae
aaattccatatgttgcacctacaaa

SEQ ID NO: 119822 - DNA, 25 bp, S. cerevisiae
gactctggatctacctataagcatg

SEQ ID NO: 119823 - DNA, 25 bp, S. cerevisiae
gactagtggtcaaaagctgttggca

SEQ ID NO: 119824 - DNA, 25 bp, S. cerevisiae
gttcaaaggcactgatttcgtacat

SEQ ID NO: 119825 - DNA, 25 bp, S. cerevisiae
gctgttggcaattaagtatggttac

SEQ ID NO: 119826 - DNA, 25 bp, S. cerevisiae
gaatctaaagatctcctacgcgcaa

SEQ ID NO: 119827 - DNA, 25 bp, S. cerevisiae
atctcctacgcgcaagttttaataa

SEQ ID NO: 119828 - DNA, 25 bp, S. cerevisiae
attcttaagggttcgtatcttcaca

SEQ ID NO: 119829 - DNA, 25 bp, S. cerevisiae
ttctaatccaaactctagccttcat

SEQ ID NO: 119830 - DNA, 25 bp, S. cerevisiae
tagccttcattcaccaacgtctgat

SEQ ID NO: 119831 - DNA, 25 bp, S. cerevisiae
gtggtccaggctttaaattcgttga

SEQ ID NO: 119832 - DNA, 25 bp, S. cerevisiae
gtagtgacggtcataacagcgagaa

SEQ ID NO: 119833 - DNA, 25 bp, S. cerevisiae
ggagcaattgatcccaatcatctta

SEQ ID NO: 119834 - DNA, 25 bp, S. cerevisiae
gatgaacccgtacctgaatctgcag

SEQ ID NO: 119835 - DNA, 25 bp, S. cerevisiae
aaatttatggctccatgccgttgga

SEQ ID NO: 119836 - DNA, 25 bp, S. cerevisiae
aattggcattggacccgaacttaat

SEQ ID NO: 119837 - DNA, 25 bp, S. cerevisiae
atcatcttaagacagcgtggtccag

SEQ ID NO: 119838 - DNA, 25 bp, S. cerevisiae
attctctagtcagtaatccacacga

SEQ ID NO: 119839 - DNA, 25 bp, S. cerevisiae
agaaggacactgatggcgctgatga

SEQ ID NO: 119840 - DNA, 25 bp, S. cerevisiae
gtcctttgacacaacattttctgat

SEQ ID NO: 119841 - DNA, 25 bp, S. cerevisiae
gtaacgcactcattcacatcaagtt

SEQ ID NO: 119842 - DNA, 25 bp, S. cerevisiae
gtgctcgatatagttcctggctcaa

SEQ ID NO: 119843 - DNA, 25 bp, S. cerevisiae
ggaagccaacgcagtgtcctttgac

SEQ ID NO: 119844 - DNA, 25 bp, S. cerevisiae
gtttaatgctcgaaagtcctaacta

SEQ ID NO: 119845 - DNA, 25 bp, S. cerevisiae
gatcgagaataagctcaccccacgg

SEQ ID NO: 119846 - DNA, 25 bp, S. cerevisiae
acatcaagttttcagctggtacgga

SEQ ID NO: 119847 - DNA, 25 bp, S. cerevisiae
taatacgtcccattcttggtaaagt

SEQ ID NO: 119848 - DNA, 25 bp, S. cerevisiae
gacttcctacattttattgtcgctg

SEQ ID NO: 119849 - DNA, 25 bp, S. cerevisiae
gagatccgtgccttcgataaactat

SEQ ID NO: 119850 - DNA, 25 bp, S. cerevisiae
caccccacggactgatcaatttgaa

SEQ ID NO: 119851 - DNA, 25 bp, S. cerevisiae
ttgcctcagggaaaatggttgttac

SEQ ID NO: 119852 - DNA, 25 bp, S. cerevisiae
ttttgctgctgtcatcatgcgtatt

SEQ ID NO: 119853 - DNA, 25 bp, S. cerevisiae
gtcatcatgcgtattagagagccaa

SEQ ID NO: 119854 - DNA, 25 bp, S. cerevisiae
tggttgttaccggtgcaaaaagtga

SEQ ID NO: 119855 - DNA, 25 bp, S. cerevisiae
gaggatgactcaaagctggccagta

SEQ ID NO: 119856 - DNA, 25 bp, S. cerevisiae
acagctttaatttttgcctcaggga

SEQ ID NO: 119857 - DNA, 25 bp, S. cerevisiae
aaaacagttgcgctacatgcccgta

SEQ ID NO: 119858 - DNA, 25 bp, S. cerevisiae
aatcgggtttgctgctaaattcaca

SEQ ID NO: 119859 - DNA, 25 bp, S. cerevisiae
gagagccaaaaactacagctttaat

SEQ ID NO: 119860 - DNA, 25 bp, S. cerevisiae
gctacatgcccgtaatgcagaatat

SEQ ID NO: 119861 - DNA, 25 bp, S. cerevisiae
atataaccccaagcgttttgctgct

SEQ ID NO: 119862 - DNA, 25 bp, S. cerevisiae
gtgtttgatccaaataccagacaag

SEQ ID NO: 119863 - DNA, 25 bp, S. cerevisiae
ggtattgttccaacactacaaaaca

SEQ ID NO: 119864 - DNA, 25 bp, S. cerevisiae
ggacataaaaagagctgccccagaa

SEQ ID NO: 119865 - DNA, 25 bp, S. cerevisiae
aaagagctgccccagaatctgaaaa

SEQ ID NO: 119866 - DNA, 25 bp, S. cerevisiae
aacattgtggcaactgtgactttgg

SEQ ID NO: 119867 - DNA, 25 bp, S. cerevisiae
tccgccacatcaggtattgttccaa

SEQ ID NO: 119868 - DNA, 25 bp, S. cerevisiae
caaaaccagcaactactttccagag

SEQ ID NO: 119869 - DNA, 25 bp, S. cerevisiae
gaatcgagatggtacaaaaccagca

SEQ ID NO: 119870 - DNA, 25 bp, S. cerevisiae
gaatctgaaaaagacacctccgcca

SEQ ID NO: 119871 - DNA, 25 bp, S. cerevisiae
atggccgatgaggaacgtttaaagg

SEQ ID NO: 119872 - DNA, 25 bp, S. cerevisiae
agcaactactttccagagtgaagag

SEQ ID NO: 119873 - DNA, 25 bp, S. cerevisiae
tttctcctcctatgagccagaattg

SEQ ID NO: 119874 - DNA, 25 bp, S. cerevisiae
gtctagaagggttagcattcagtca

SEQ ID NO: 119875 - DNA, 25 bp, S. cerevisiae
ggtgaagccgaaaattgtgttgtta

SEQ ID NO: 119876 - DNA, 25 bp, S. cerevisiae
gttcgtgtgacgttaaattccctat

SEQ ID NO: 119877 - DNA, 25 bp, S. cerevisiae
gattgttcttactggtgcaaagcaa

SEQ ID NO: 119878 - DNA, 25 bp, S. cerevisiae
gttaaattccctatacgtctagaag

SEQ ID NO: 119879 - DNA, 25 bp, S. cerevisiae
cagaattgtttcctggtttgatcta

SEQ ID NO: 119880 - DNA, 25 bp, S. cerevisiae
gctatataccctgtgctaagtgaat

SEQ ID NO: 119881 - DNA, 25 bp, S. cerevisiae
gcttttgaagctatataccctgtgc

SEQ ID NO: 119882 - DNA, 25 bp, S. cerevisiae
gaagaaatttaccaagcttttgaag

SEQ ID NO: 119883 - DNA, 25 bp, S. cerevisiae
gcattcagtcatggtactttctcct

SEQ ID NO: 119884 - DNA, 25 bp, S. cerevisiae
tttagcggctatcccattgggtaaa

SEQ ID NO: 119885 - DNA, 25 bp, S. cerevisiae
ttagacacagaactcctcatgaaat

SEQ ID NO: 119886 - DNA, 25 bp, S. cerevisiae
tttgaaggacccacagaccgatgct

SEQ ID NO: 119887 - DNA, 25 bp, S. cerevisiae
gatatgtccgctttgaaggacccac

SEQ ID NO: 119888 - DNA, 25 bp, S. cerevisiae
gttgaagttaatttagcggctatcc

SEQ ID NO: 119889 - DNA, 25 bp, S. cerevisiae
aaacgtggttgtcaaatggcaaggt

SEQ ID NO: 119890 - DNA, 25 bp, S. cerevisiae
aagccaacagtgtggatatgtccgc

SEQ ID NO: 119891 - DNA, 25 bp, S. cerevisiae
gaaacctttatttcatctatgaccg

SEQ ID NO: 119892 - DNA, 25 bp, S. cerevisiae
ctactgccgatgttttggctatggc

SEQ ID NO: 119893 - DNA, 25 bp, S. cerevisiae
caaggtaagcctgtgttcattagac

SEQ ID NO: 119894 - DNA, 25 bp, S. cerevisiae
atctatgaccgctactgccgatgtt

SEQ ID NO: 119895 - DNA, 25 bp, S. cerevisiae
ggtcggtgctatgggtcttttgtca

SEQ ID NO: 119896 - DNA, 25 bp, S. cerevisiae
gtcttttgtcatctgcaggtgccaa

SEQ ID NO: 119897 - DNA, 25 bp, S. cerevisiae
gatcatctgtcaagacctgcttcaa

SEQ ID NO: 119898 - DNA, 25 bp, S. cerevisiae
gatttctcaatctttgctggctagc

SEQ ID NO: 119899 - DNA, 25 bp, S. cerevisiae
gacctgcttcaagccaatgtcttta

SEQ ID NO: 119900 - DNA, 25 bp, S. cerevisiae
cgtacaggaccccaaattttgatga

SEQ ID NO: 119901 - DNA, 25 bp, S. cerevisiae
caagccaatgtctttaacttccaaa

SEQ ID NO: 119902 - DNA, 25 bp, S. cerevisiae
cgatgctgataaaggccgttcttat

SEQ ID NO: 119903 - DNA, 25 bp, S. cerevisiae
gctggctagcaaatccacgtacagg

SEQ ID NO: 119904 - DNA, 25 bp, S. cerevisiae
atgcttactttatggtcggtgctat

SEQ ID NO: 119905 - DNA, 25 bp, S. cerevisiae
aggccgttcttatgcttactttatg

SEQ ID NO: 119906 - DNA, 25 bp, S. cerevisiae
ttggtggttggttctgtccttgcca

SEQ ID NO: 119907 - DNA, 25 bp, S. cerevisiae
gtactcacttaggttgtgttccaat

SEQ ID NO: 119908 - DNA, 25 bp, S. cerevisiae
gtccttgccatggttcacattatga

SEQ ID NO: 119909 - DNA, 25 bp, S. cerevisiae
gttccaattggtgaagccggtgatt

SEQ ID NO: 119910 - DNA, 25 bp, S. cerevisiae
gtagaatcagaaagggacctgcccc

SEQ ID NO: 119911 - DNA, 25 bp, S. cerevisiae
aaacttagaaattcctgcttatgaa

SEQ ID NO: 119912 - DNA, 25 bp, S. cerevisiae
gacagagtcaaagaccctcaatggt

SEQ ID NO: 119913 - DNA, 25 bp, S. cerevisiae
cctgcttatgaattcgatggtgata

SEQ ID NO: 119914 - DNA, 25 bp, S. cerevisiae
cctcaatggttaattatgctgggta

SEQ ID NO: 119915 - DNA, 25 bp, S. cerevisiae
cacattatgatatttccggtagaat

SEQ ID NO: 119916 - DNA, 25 bp, S. cerevisiae
atgctgggtatttgtactcacttag

SEQ ID NO: 119917 - DNA, 25 bp, S. cerevisiae
ggtgcatcgcaactgcaaccacatg

SEQ ID NO: 119918 - DNA, 25 bp, S. cerevisiae
gtataaagaccggtgcatcgcaact

SEQ ID NO: 119919 - DNA, 25 bp, S. cerevisiae
gtctacacggtttggaaatgcatga

SEQ ID NO: 119920 - DNA, 25 bp, S. cerevisiae
ggtaccagtgctactataactacga

SEQ ID NO: 119921 - DNA, 25 bp, S. cerevisiae
aaagtggatctgctggtaccagtgc

SEQ ID NO: 119922 - DNA, 25 bp, S. cerevisiae
acatggcgcattcaatggacccaaa

SEQ ID NO: 119923 - DNA, 25 bp, S. cerevisiae
aatgcatgatatcgagaagctcctt

SEQ ID NO: 119924 - DNA, 25 bp, S. cerevisiae
gaagctccttgacgaaaagtacgat

SEQ ID NO: 119925 - DNA, 25 bp, S. cerevisiae
gcaaccacatgcaaatgctggcaaa

SEQ ID NO: 119926 - DNA, 25 bp, S. cerevisiae
ataactacgactacgccacacatgg

SEQ ID NO: 119927 - DNA, 25 bp, S. cerevisiae
atggacaacttagtctacacggttt

SEQ ID NO: 119928 - DNA, 25 bp, S. cerevisiae
ttcgaatatcgctagtcaagttgac

SEQ ID NO: 119929 - DNA, 25 bp, S. cerevisiae
ttgggaataatcttcgaatatcgct

SEQ ID NO: 119930 - DNA, 25 bp, S. cerevisiae
gggcatcaacgatatcctgaccata

SEQ ID NO: 119931 - DNA, 25 bp, S. cerevisiae
ggcaaagcaacgtggcaaatggaaa

SEQ ID NO: 119932 - DNA, 25 bp, S. cerevisiae
gttgcagctaatacacactttaatt

SEQ ID NO: 119933 - DNA, 25 bp, S. cerevisiae
gatatcctgaccatagttaagaatt

SEQ ID NO: 119934 - DNA, 25 bp, S. cerevisiae
acgagctgacaaatttaagaaggca

SEQ ID NO: 119935 - DNA, 25 bp, S. cerevisiae
acaatttgctaatcaacgagctgac

SEQ ID NO: 119936 - DNA, 25 bp, S. cerevisiae
aagtgaattggtagtgttgcagcta

SEQ ID NO: 119937 - DNA, 25 bp, S. cerevisiae
gaaactgggcatcaacgatatcctg

SEQ ID NO: 119938 - DNA, 25 bp, S. cerevisiae
gaatttattcccagagtacagaaca

SEQ ID NO: 119939 - DNA, 25 bp, S. cerevisiae
ttcaaaagagcataacggacggtgt

SEQ ID NO: 119940 - DNA, 25 bp, S. cerevisiae
ggtacggacgactggaaattggcta

SEQ ID NO: 119941 - DNA, 25 bp, S. cerevisiae
aactgggaattttcagaagctattc

SEQ ID NO: 119942 - DNA, 25 bp, S. cerevisiae
gagtcccgatggtagcattatcaag

SEQ ID NO: 119943 - DNA, 25 bp, S. cerevisiae
aattggctagacaagtgcagtttga

SEQ ID NO: 119944 - DNA, 25 bp, S. cerevisiae
gaattggatgatacggtgcagttca

SEQ ID NO: 119945 - DNA, 25 bp, S. cerevisiae
gaagctattcaagagtcccgatggt

SEQ ID NO: 119946 - DNA, 25 bp, S. cerevisiae
ataaagaacgaaacgcccggcagcg

SEQ ID NO: 119947 - DNA, 25 bp, S. cerevisiae
cgaaaggtcattggtacggacgact

SEQ ID NO: 119948 - DNA, 25 bp, S. cerevisiae
atacggtgcagttcatgagaagagc

SEQ ID NO: 119949 - DNA, 25 bp, S. cerevisiae
agcgttcatgaactgcagctgattc

SEQ ID NO: 119950 - DNA, 25 bp, S. cerevisiae
ttggattccggtgatggtgttactc

SEQ ID NO: 119951 - DNA, 25 bp, S. cerevisiae
gtgttactcacgtcgttccaattta

SEQ ID NO: 119952 - DNA, 25 bp, S. cerevisiae
acgtcgccttggacttcgaacaaga

SEQ ID NO: 119953 - DNA, 25 bp, S. cerevisiae
aaatgcaaaccgctgctcaatcttc

SEQ ID NO: 119954 - DNA, 25 bp, S. cerevisiae
aatcctacgaacttccagatggtca

SEQ ID NO: 119955 - DNA, 25 bp, S. cerevisiae
aatttacgctggtttctctctacct

SEQ ID NO: 119956 - DNA, 25 bp, S. cerevisiae
tccttgtactcttccggtagaacta

SEQ ID NO: 119957 - DNA, 25 bp, S. cerevisiae
gaaaaactatgttacgtcgccttgg

SEQ ID NO: 119958 - DNA, 25 bp, S. cerevisiae
gagatttgactgactacttgatgaa

SEQ ID NO: 119959 - DNA, 25 bp, S. cerevisiae
atccaagccgttttgtccttgtact

SEQ ID NO: 119960 - DNA, 25 bp, S. cerevisiae
agtgaacgtggttactctttctcca

SEQ ID NO: 119961 - DNA, 25 bp, S. cerevisiae
gtatcttgactttacgttacccaat

SEQ ID NO: 119962 - DNA, 25 bp, S. cerevisiae
tgtcttcccatctatcgtcggtaga

SEQ ID NO: 119963 - DNA, 25 bp, S. cerevisiae
ggtatgtgtaaagccggttttgccg

SEQ ID NO: 119964 - DNA, 25 bp, S. cerevisiae
gattctgaggttgctgctttggtta

SEQ ID NO: 119965 - DNA, 25 bp, S. cerevisiae
aacacggtattgtcaccaactggga

SEQ ID NO: 119966 - DNA, 25 bp, S. cerevisiae
aagactcctacgttggtgatgaagc

SEQ ID NO: 119967 - DNA, 25 bp, S. cerevisiae
gacaccaaggtatcatggtcggtat

SEQ ID NO: 119968 - DNA, 25 bp, S. cerevisiae
gaacaccctgttcttttgactgaag

SEQ ID NO: 119969 - DNA, 25 bp, S. cerevisiae
gactgaagctccaatgaaccctaaa

SEQ ID NO: 119970 - DNA, 25 bp, S. cerevisiae
gagagttgccccagaagaacaccct

SEQ ID NO: 119971 - DNA, 25 bp, S. cerevisiae
agatctggcatcataccttctacaa

SEQ ID NO: 119972 - DNA, 25 bp, S. cerevisiae
ttggctccatcttccatgaaggtca

SEQ ID NO: 119973 - DNA, 25 bp, S. cerevisiae
gtggttctatcttggcttctttgac

SEQ ID NO: 119974 - DNA, 25 bp, S. cerevisiae
ggaatctgccggtattgaccaaact

SEQ ID NO: 119975 - DNA, 25 bp, S. cerevisiae
gattcagagccccagaagctttgtt

SEQ ID NO: 119976 - DNA, 25 bp, S. cerevisiae
aacatcgttatgtccggtggtacca

SEQ ID NO: 119977 - DNA, 25 bp, S. cerevisiae
aagctttgttccatccttctgtttt

SEQ ID NO: 119978 - DNA, 25 bp, S. cerevisiae
tgaccaaactacttacaactccatc

SEQ ID NO: 119979 - DNA, 25 bp, S. cerevisiae
tcaagatcattgctcctccagaaag

SEQ ID NO: 119980 - DNA, 25 bp, S. cerevisiae
gaaagtggtccatctatcgttcacc

SEQ ID NO: 119981 - DNA, 25 bp, S. cerevisiae
ccatgttcccaggtattgccgaaag

SEQ ID NO: 119982 - DNA, 25 bp, S. cerevisiae
agtactccgtctggattggtggttc

SEQ ID NO: 119983 - DNA, 25 bp, S. cerevisiae
ttctcgcatcgatgaagaacgcagc

SEQ ID NO: 119984 - DNA, 25 bp, S. cerevisiae
gggcatgcctgtttgagcgtcattt

SEQ ID NO: 119985 - DNA, 25 bp, S. cerevisiae
gtgaatcatcgaatctttgaacgca

SEQ ID NO: 119986 - DNA, 25 bp, S. cerevisiae
acattgcgccccttggtattccagg

SEQ ID NO: 119987 - DNA, 25 bp, S. cerevisiae
aacaacggatctcttggttctcgca

SEQ ID NO: 119988 - DNA, 25 bp, S. cerevisiae
aaactttcaacaacggatctcttgg

SEQ ID NO: 119989 - DNA, 25 bp, S. cerevisiae
tcgaatctttgaacgcacattgcgc

SEQ ID NO: 119990 - DNA, 25 bp, S. cerevisiae
gaacgcagcgaaatgcgatacgtaa

SEQ ID NO: 119991 - DNA, 25 bp, S. cerevisiae
gaattgcagaattccgtgaatcatc

SEQ ID NO: 119992 - DNA, 25 bp, S. cerevisiae
gcgatacgtaatgtgaattgcagaa

SEQ ID NO: 119993 - DNA, 25 bp, S. cerevisiae
atctcttggttctcgcatcgatgaa

SEQ ID NO: 119994 - DNA, 25 bp, S. cerevisiae
gtgacggcccgtgaaaatccacagg

SEQ ID NO: 119995 - DNA, 25 bp, S. cerevisiae
ggatatggattcttcacggtaacgt

SEQ ID NO: 119996 - DNA, 25 bp, S. cerevisiae
ggtcgtactgataaccgcagcaggt

SEQ ID NO: 119997 - DNA, 25 bp, S. cerevisiae
aacggcctctagtgcagatcttggt

SEQ ID NO: 119998 - DNA, 25 bp, S. cerevisiae
tgattttatgcaggccaccatcgaa

SEQ ID NO: 119999 - DNA, 25 bp, S. cerevisiae
taaggtcgggtcgaacggcctctag

SEQ ID NO: 120000 - DNA, 25 bp, S. cerevisiae
gaaaggttccacgtcaacagcagtt

SEQ ID NO: 120001 - DNA, 25 bp, S. cerevisiae
gttggacgtgggttagtcgatccta

SEQ ID NO: 120002 - DNA, 25 bp, S. cerevisiae
gaagctccgtttcaaaggcctgatt

SEQ ID NO: 120003 - DNA, 25 bp, S. cerevisiae
gaatagttttcatgccaggtcgtac

SEQ ID NO: 120004 - DNA, 25 bp, S. cerevisiae
aggtctccaaggtgaacagcctcta

SEQ ID NO: 120005 - DNA, 25 bp, S. cerevisiae
tttgaaatctggtaccttcggtgcc

SEQ ID NO: 120006 - DNA, 25 bp, S. cerevisiae
ttcggtgcccgagttgtaatttgga

SEQ ID NO: 120007 - DNA, 25 bp, S. cerevisiae
gggaatctcgcatttcactgggcca

SEQ ID NO: 120008 - DNA, 25 bp, S. cerevisiae
ggaatgtagcttgcctcggtaagta

SEQ ID NO: 120009 - DNA, 25 bp, S. cerevisiae
ggagtacccgctgaacttaagcata

SEQ ID NO: 120010 - DNA, 25 bp, S. cerevisiae
actgccagctgggactgaggactgc

SEQ ID NO: 120011 - DNA, 25 bp, S. cerevisiae
tcactgggccagcatcagttttggt

SEQ ID NO: 120012 - DNA, 25 bp, S. cerevisiae
cgttccttgtctatgttccttggaa

SEQ ID NO: 120013 - DNA, 25 bp, S. cerevisiae
gcggttctttgtaaagtgccttcga

SEQ ID NO: 120014 - DNA, 25 bp, S. cerevisiae
atcagacatggtgttttgtgccctc

SEQ ID NO: 120015 - DNA, 25 bp, S. cerevisiae
atagcctgtgggaatactgccagct

SEQ ID NO: 120016 - DNA, 25 bp, S. cerevisiae
ttttgcggctgtctgatcaggcatt

SEQ ID NO: 120017 - DNA, 25 bp, S. cerevisiae
tgtggcagtcaagcgttcatagcga

SEQ ID NO: 120018 - DNA, 25 bp, S. cerevisiae
ggcgtcgctgaaccatagcaggcta

SEQ ID NO: 120019 - DNA, 25 bp, S. cerevisiae
acaggttagttttaccctactgatg

SEQ ID NO: 120020 - DNA, 25 bp, S. cerevisiae
aagcgttggattgttcacccactaa

SEQ ID NO: 120021 - DNA, 25 bp, S. cerevisiae
aataaggcgtccttgtggcgtcgct

SEQ ID NO: 120022 - DNA, 25 bp, S. cerevisiae
tccgctggattatggctgaacgcct

SEQ ID NO: 120023 - DNA, 25 bp, S. cerevisiae
gccttgttgttacgatctgctgaga

SEQ ID NO: 120024 - DNA, 25 bp, S. cerevisiae
gctttttgattcttcgatgtcggct

SEQ ID NO: 120025 - DNA, 25 bp, S. cerevisiae
gctagcaacggtgcacttggcggaa

SEQ ID NO: 120026 - DNA, 25 bp, S. cerevisiae
agaacgcggtgatttctttgctcca

SEQ ID NO: 120027 - DNA, 25 bp, S. cerevisiae
tttttaatgacccactcggcacctt

SEQ ID NO: 120028 - DNA, 25 bp, S. cerevisiae
ttctggctaaccttgagtccttgtg

SEQ ID NO: 120029 - DNA, 25 bp, S. cerevisiae
gggcatcagtattcaattgtcagag

SEQ ID NO: 120030 - DNA, 25 bp, S. cerevisiae
tggcgaaccaggacttttactttga

SEQ ID NO: 120031 - DNA, 25 bp, S. cerevisiae
gataccgtcgtagtcttaaccataa

SEQ ID NO: 120032 - DNA, 25 bp, S. cerevisiae
gattttttcgtgtactggatttcca

SEQ ID NO: 120033 - DNA, 25 bp, S. cerevisiae
gaattgacggaagggcaccaccagg

SEQ ID NO: 120034 - DNA, 25 bp, S. cerevisiae
gcatttgccaaggacgttttcatta

SEQ ID NO: 120035 - DNA, 25 bp, S. cerevisiae
agctcgtagttgaactttgggcccg

SEQ ID NO: 120036 - DNA, 25 bp, S. cerevisiae
agcctgcggcttaatttgactcaac

SEQ ID NO: 120037 - DNA, 25 bp, S. cerevisiae
agtccttgtggctcttggcgaacca

SEQ ID NO: 120038 - DNA, 25 bp, S. cerevisiae
ggttcattcaaatttctgccctatc

SEQ ID NO: 120039 - DNA, 25 bp, S. cerevisiae
ggtaattccagctccaatagcgtat

SEQ ID NO: 120040 - DNA, 25 bp, S. cerevisiae
ggatagtggcctaccatggtttcaa

SEQ ID NO: 120041 - DNA, 25 bp, S. cerevisiae
acatgcttaaaatctcgaccctttg

SEQ ID NO: 120042 - DNA, 25 bp, S. cerevisiae
aacttttcgaatcgcatggccttgt

SEQ ID NO: 120043 - DNA, 25 bp, S. cerevisiae
tctgccctatcaactttcgatggta

SEQ ID NO: 120044 - DNA, 25 bp, S. cerevisiae
ggcccattcgggtcttgtaattgga

SEQ ID NO: 120045 - DNA, 25 bp, S. cerevisiae
gagaaacggctaccacatccaagga

SEQ ID NO: 120046 - DNA, 25 bp, S. cerevisiae
gccagtagtcatatgcttgtctcaa

SEQ ID NO: 120047 - DNA, 25 bp, S. cerevisiae
cttgtgctggcgatggttcattcaa

SEQ ID NO: 120048 - DNA, 25 bp, S. cerevisiae
atgtcttcggactctttgatgattc

SEQ ID NO: 120049 - DNA, 25 bp, S. cerevisiae
ttagagggactatcggtttcaagcc

SEQ ID NO: 120050 - DNA, 25 bp, S. cerevisiae
tacactgacggagccagcgagtcta

SEQ ID NO: 120051 - DNA, 25 bp, S. cerevisiae
taatcttgtgaaactccgtcgtgct

SEQ ID NO: 120052 - DNA, 25 bp, S. cerevisiae
cagcgagtctaaccttggccgagag

SEQ ID NO: 120053 - DNA, 25 bp, S. cerevisiae
gcccgtcgctagtaccgattgaatg

SEQ ID NO: 120054 - DNA, 25 bp, S. cerevisiae
catggccgttcttagttggtggagt

SEQ ID NO: 120055 - DNA, 25 bp, S. cerevisiae
gcatttgctggttatccacttctta

SEQ ID NO: 120056 - DNA, 25 bp, S. cerevisiae
atcagcttgcgttgattacgtccct

SEQ ID NO: 120057 - DNA, 25 bp, S. cerevisiae
ataacaggtctgtgatgcccttaga

SEQ ID NO: 120058 - DNA, 25 bp, S. cerevisiae
agtgaggcctcaggatctgcttaga

SEQ ID NO: 120059 - DNA, 25 bp, S. cerevisiae
agagctctttcttgattttgtgggt

SEQ ID NO: 120060 - DNA, 25 bp, P1 bacteriophage
ttgggccagctaaacatgcttcatc

SEQ ID NO: 120061 - DNA, 25 bp, P1 bacteriophage
gggattgcttataacaccctgttac

SEQ ID NO: 120062 - DNA, 25 bp, P1 bacteriophage
gatcgccaggcgttttctgagcata

SEQ ID NO: 120063 - DNA, 25 bp, P1 bacteriophage
gatgttcgcgattatcttctatatc

SEQ ID NO: 120064 - DNA, 25 bp, P1 bacteriophage
gccggtgaacgtgcaaaacaggctc

SEQ ID NO: 120065 - DNA, 25 bp, P1 bacteriophage
gcactgatttcgaccaggttcgttc

SEQ ID NO: 120066 - DNA, 25 bp, P1 bacteriophage
gcaaaacaggctctagcgttcgaac

SEQ ID NO: 120067 - DNA, 25 bp, P1 bacteriophage
gctgtttcactggttatgcggcgga

SEQ ID NO: 120068 - DNA, 25 bp, P1 bacteriophage
cggaaatggtttcccgcagaacctg

SEQ ID NO: 120069 - DNA, 25 bp, P1 bacteriophage
atcgctgccaggatatacgtaatct

SEQ ID NO: 120070 - DNA, 25 bp, P1 bacteriophage
tctgtccgtttgccggtcgtgggcg

SEQ ID NO: 120071 - DNA, 25 bp, P1 bacteriophage
tagctgatgatccgaataactacct

SEQ ID NO: 120072 - DNA, 25 bp, P1 bacteriophage
ggtcgagcgatggatttccgtctct

SEQ ID NO: 120073 - DNA, 25 bp, P1 bacteriophage
gttaatccatattggcagaacgaaa

SEQ ID NO: 120074 - DNA, 25 bp, P1 bacteriophage
aaaaaatggtgttgccgcgccatct

SEQ ID NO: 120075 - DNA, 25 bp, P1 bacteriophage
aacgaaaacgctggttagcaccgca

SEQ ID NO: 120076 - DNA, 25 bp, P1 bacteriophage
aagatatctcacgtactgacggtgg

SEQ ID NO: 120077 - DNA, 25 bp, P1 bacteriophage
ccagctatcaactcgcgccctggaa

SEQ ID NO: 120078 - DNA, 25 bp, P1 bacteriophage
ctgttttgccgggtcagaaaaaatg

SEQ ID NO: 120079 - DNA, 25 bp, P1 bacteriophage
cgctggttagcaccgcaggtgtaga

SEQ ID NO: 120080 - DNA, 25 bp, P1 bacteriophage
atgatccgaataactacctgttttg

SEQ ID NO: 120081 - DNA, 25 bp, P1 bacteriophage
ataactacctgttttgccgggtcag

SEQ ID NO: 120082 - DNA, 25 bp, E. coli
gtaaatccttacaccttcgcagaac

SEQ ID NO: 120083 - DNA, 25 bp, E. coli
gggcagaccgatagaatcattggta

SEQ ID NO: 120084 - DNA, 25 bp, E. coli
cgcaacagtaaatccttacaccttc

SEQ ID NO: 120085 - DNA, 25 bp, E. coli
cctctggcagcgaaaagaccccgga

SEQ ID NO: 120086 - DNA, 25 bp, E. coli
cctgcagctggattacgcaacagta

SEQ ID NO: 120087 - DNA, 25 bp, E. coli
ctggcagcgaaaagaccccggaagg

SEQ ID NO: 120088 - DNA, 25 bp, E. coli
gaatcattggtaatgagcgccggat

SEQ ID NO: 120089 - DNA, 25 bp, E. coli
cttacaccttcgcagaacccacttc

SEQ ID NO: 120090 - DNA, 25 bp, E. coli
acgcaacagtaaatccttacacctt

SEQ ID NO: 120091 - DNA, 25 bp, E. coli
agcctgcagctggattacgcaacag

SEQ ID NO: 120092 - DNA, 25 bp, E. coli
gcagcaggctaccggacggcaggtt

SEQ ID NO: 120093 - DNA, 25 bp, E. coli
ttctgacactttcacttttgcagat

SEQ ID NO: 120094 - DNA, 25 bp, E. coli
gtcacgctgaatatatgaccacgct

SEQ ID NO: 120095 - DNA, 25 bp, E. coli
acttttgcagattgggtaacacagg

SEQ ID NO: 120096 - DNA, 25 bp, E. coli
aacaactgccggtgatactggtagt

SEQ ID NO: 120097 - DNA, 25 bp, E. coli
acaacacgccggactgactctggcg

SEQ ID NO: 120098 - DNA, 25 bp, E. coli
aactcggctgtattaatcacgcgat

SEQ ID NO: 120099 - DNA, 25 bp, E. coli
tgctgggagagatcccctggcttgc

SEQ ID NO: 120100 - DNA, 25 bp, E. coli
tcacgctgaatatatgaccacgctc

SEQ ID NO: 120101 - DNA, 25 bp, E. coli
tgacactttcacttttgcagattgg

SEQ ID NO: 120102 - DNA, 25 bp, E. coli
gccggtgatactggtagttggtgtg

SEQ ID NO: 120103 - DNA, 25 bp, E. coli
cacaggtaatacaacacgccggact

SEQ ID NO: 120104 - DNA, 25 bp, E. coli
acgttcgatcttgcatggagcaatc

SEQ ID NO: 120105 - DNA, 25 bp, E. coli
gtaaatacacccacgtactggacgc

SEQ ID NO: 120106 - DNA, 25 bp, E. coli
cacggcactccgcgagctgtatcgg

SEQ ID NO: 120107 - DNA, 25 bp, E. coli
acgcgggttgtggacctggctggat

SEQ ID NO: 120108 - DNA, 25 bp, E. coli
ctgccgttagcgactgcgacgttcg

SEQ ID NO: 120109 - DNA, 25 bp, E. coli
ccagaaggatgccgcagaccattat

SEQ ID NO: 120110 - DNA, 25 bp, E. coli
cgccgccaatgcttgttcaggcacg

SEQ ID NO: 120111 - DNA, 25 bp, E. coli
gcatggagcaatctcgcagtgcagt

SEQ ID NO: 120112 - DNA, 25 bp, E. coli
atgcagatctacagcgccagagtgc

SEQ ID NO: 120113 - DNA, 25 bp, E. coli
atggagcaatctcgcagtgcagtgg

SEQ ID NO: 120114 - DNA, 25 bp, E. coli
aggatgccgcagaccattatctggc

SEQ ID NO: 120115 - DNA, 25 bp, E. coli
tattaacgcgttcgcagttgcagcg

SEQ ID NO: 120116 - DNA, 25 bp, E. coli
gtggacgagcgtccgcatgctaatc

SEQ ID NO: 120117 - DNA, 25 bp, E. coli
tcatattcagcccatcacgctgtgg

SEQ ID NO: 120118 - DNA, 25 bp, E. coli
gaacggcgtgcattatcaacatcat

SEQ ID NO: 120119 - DNA, 25 bp, E. coli
cgctggtgcagggatcgttacccga

SEQ ID NO: 120120 - DNA, 25 bp, E. coli
cggtgccacgcatcttcatgaaggg

SEQ ID NO: 120121 - DNA, 25 bp, E. coli
cagcgattgcaactggcctggccgc

SEQ ID NO: 120122 - DNA, 25 bp, E. coli
cacgctgtggtttgatgatgcgctc

SEQ ID NO: 120123 - DNA, 25 bp, E. coli
atcaacatcatattcagcccatcac

SEQ ID NO: 120124 - DNA, 25 bp, E. coli
accgccagatgaaatcgaacagtcg

SEQ ID NO: 120125 - DNA, 25 bp, E. coli
agtgccatgcgttcgctgaaaggca

SEQ ID NO: 120126 - DNA, 25 bp, E. coli
tgtatgacgctgggcacgttgagtg

SEQ ID NO: 120127 - DNA, 25 bp, E. coli
aaaagatcgcgccggattattgctg

SEQ ID NO: 120128 - DNA, 25 bp, E. coli
tgccgggatcaaagtctgttctggc

SEQ ID NO: 120129 - DNA, 25 bp, E. coli
cggaaagcgtgccaatcaacatgct

SEQ ID NO: 120130 - DNA, 25 bp, E. coli
ccggattattgctgcaactggcaaa

SEQ ID NO: 120131 - DNA, 25 bp, E. coli
cacgcacttatcaggaacgcctcga

SEQ ID NO: 120132 - DNA, 25 bp, E. coli
ccgggatcaaagtctgttctggcgg

SEQ ID NO: 120133 - DNA, 25 bp, E. coli
cgggatcaaagtctgttctggcggc

SEQ ID NO: 120134 - DNA, 25 bp, E. coli
gctgggcacgttgagtgaatctcag

SEQ ID NO: 120135 - DNA, 25 bp, E. coli
gcattgtgggcttaggcgaaacggt

SEQ ID NO: 120136 - DNA, 25 bp, E. coli
agatcgcgccggattattgctgcaa

SEQ ID NO: 120137 - DNA, 25 bp, E. coli
tttcgatcctcgtcaggtgcaggtc

SEQ ID NO: 120138 - DNA, 25 bp, E. coli
ttcgatcctcgtcaggtgcaggtca

SEQ ID NO: 120139 - DNA, 25 bp, E. coli
aagccgagcggttgatggaagttga

SEQ ID NO: 120140 - DNA, 25 bp, E. coli
tcgcgctacaaaaccgggctggaag

SEQ ID NO: 120141 - DNA, 25 bp, E. coli
tcgatcctcgtcaggtgcaggtcag

SEQ ID NO: 120142 - DNA, 25 bp, E. coli
gagcggttgatggaagttgaacagg

SEQ ID NO: 120143 - DNA, 25 bp, E. coli
cggcaggatcgacgcgcttctgtat

SEQ ID NO: 120144 - DNA, 25 bp, E. coli
ctggatctgctgtttgaagcgcagc

SEQ ID NO: 120145 - DNA, 25 bp, E. coli
catttcgatcctcgtcaggtgcagg

SEQ ID NO: 120146 - DNA, 25 bp, E. coli
cgcgctacaaaaccgggctggaagc

SEQ ID NO: 120147 - DNA, 25 bp, E. coli
gctggatctgctgtttgaagcgcag

SEQ ID NO: 120148 - DNA, 25 bp, E. coli
tttctacggttgcaaactgctgacc

SEQ ID NO: 120149 - DNA, 25 bp, E. coli
tatggcaggcgcaaactcgattttc

SEQ ID NO: 120150 - DNA, 25 bp, E. coli
gggataacgaacaacagcaacgtct

SEQ ID NO: 120151 - DNA, 25 bp, E. coli
actggggctaaatccgcagcaaact

SEQ ID NO: 120152 - DNA, 25 bp, E. coli
acaacagcaacgtcttgaacaggcg

SEQ ID NO: 120153 - DNA, 25 bp, E. coli
tgccaacctcttacgtgcgcctttc

SEQ ID NO: 120154 - DNA, 25 bp, E. coli
gaacagactcaggcgatgtgcttta

SEQ ID NO: 120155 - DNA, 25 bp, E. coli
caacctcttacgtgcgcctttctgc

SEQ ID NO: 120156 - DNA, 25 bp, E. coli
gcaaactcgattttctacggttgca

SEQ ID NO: 120157 - DNA, 25 bp, E. coli
gcaaactggggctaaatccgcagca

SEQ ID NO: 120158 - DNA, 25 bp, E. coli
agactcaggcgatgtgctttatggc

SEQ ID NO: 120159 - DNA, 25 bp, B. subtillis
tatcagctgatcgcccgtgtagaag

SEQ ID NO: 120160 - DNA, 25 bp, B. subtillis
gataacctgatctaccaagtggcta

SEQ ID NO: 120161 - DNA, 25 bp, B. subtillis
gttcttgcgcgtctatcgcaggagt

SEQ ID NO: 120162 - DNA, 25 bp, B. subtillis
aaatgcctcctgtccatgtgaaggt

SEQ ID NO: 120163 - DNA, 25 bp, B. subtillis
aaatcaagcctgtcacattgccgac

SEQ ID NO: 120164 - DNA, 25 bp, B. subtillis
tctgtcactgttcccggaagcacag

SEQ ID NO: 120165 - DNA, 25 bp, B. subtillis
tgaaatccttcacgcatatcagctg

SEQ ID NO: 120166 - DNA, 25 bp, B. subtillis
gaacgaagccgacatgctgttctct

SEQ ID NO: 120167 - DNA, 25 bp, B. subtillis
tcagtcggaatggcgctcagcagat

SEQ ID NO: 120168 - DNA, 25 bp, B. subtillis
gccccggctttgattcagtcggaat

SEQ ID NO: 120169 - DNA, 25 bp, B. subtillis
agatccgaacacagcggtcgacatt

SEQ ID NO: 120170 - DNA, 25 bp, B. subtillis
gtcaacaggtaacacttccgctgct

SEQ ID NO: 120171 - DNA, 25 bp, B. subtillis
gtaacagatcaaacaccggcgctaa

SEQ ID NO: 120172 - DNA, 25 bp, B. subtillis
gtcaacccttaccgcattgaaggcc

SEQ ID NO: 120173 - DNA, 25 bp, B. subtillis
gatgcgcttaaaattgtccgttcca

SEQ ID NO: 120174 - DNA, 25 bp, B. subtillis
aaactgctgccttcgaagtgtgcga

SEQ ID NO: 120175 - DNA, 25 bp, B. subtillis
aactcgctcaagctgtcatgtacgg

SEQ ID NO: 120176 - DNA, 25 bp, B. subtillis
gacggaaactttgacgatgcgctta

SEQ ID NO: 120177 - DNA, 25 bp, B. subtillis
gaaatgcattgtcatcatcccgaac

SEQ ID NO: 120178 - DNA, 25 bp, B. subtillis
caggccttccgaaaatgcgcggctt

SEQ ID NO: 120179 - DNA, 25 bp, B. subtillis
gcatatgcagcccgtgctaacatga

SEQ ID NO: 120180 - DNA, 25 bp, B. subtillis
agcgcctgatgttttagcgatcccg

SEQ ID NO: 120181 - DNA, 25 bp, B. subtillis
gtgatcggcctgcatgaggatgacg

SEQ ID NO: 120182 - DNA, 25 bp, B. subtillis
ggattggccgcttgtcgggaaaatc

SEQ ID NO: 120183 - DNA, 25 bp, B. subtillis
acgcgagagacgtgcttccgaagga

SEQ ID NO: 120184 - DNA, 25 bp, B. subtillis
aaagaacagctcgcgcttcatttcc

SEQ ID NO: 120185 - DNA, 25 bp, B. subtillis
tcctcattgctgcgatcatgtccaa

SEQ ID NO: 120186 - DNA, 25 bp, B. subtillis
gacgagacccaaatgatccgcgtcc

SEQ ID NO: 120187 - DNA, 25 bp, B. subtillis
gacgtagtcgttgtcattccttttt

SEQ ID NO: 120188 - DNA, 25 bp, B. subtillis
gaagggcgcatatggaacggctctc

SEQ ID NO: 120189 - DNA, 25 bp, B. subtillis
gaaggagtttccatatgccgatgcc

SEQ ID NO: 120190 - DNA, 25 bp, B. subtillis
gaaggatatgttccatcagccgtac

SEQ ID NO: 120191 - DNA, 25 bp, B. subtillis
atgcttgtgcctgagctgtcaaaag

SEQ ID NO: 120192 - DNA, 25 bp, B. subtillis
tacatttacacatctagcagtcagt

SEQ ID NO: 120193 - DNA, 25 bp, B. subtillis
ggagtgtatagatgcagccgttgca

SEQ ID NO: 120194 - DNA, 25 bp, B. subtillis
gttgcaggcgaagttgattttgctt

SEQ ID NO: 120195 - DNA, 25 bp, B. subtillis
aatcgtgggtgaaatgacgttgccg

SEQ ID NO: 120196 - DNA, 25 bp, B. subtillis
tcggttatttaggtccagcagctac

SEQ ID NO: 120197 - DNA, 25 bp, B. subtillis
gaacatgttgcttaccgcaccattc

SEQ ID NO: 120198 - DNA, 25 bp, B. subtillis
ccgaacatgttgcttaccgcaccat

SEQ ID NO: 120199 - DNA, 25 bp, B. subtillis
ctacatttacacatctagcagtcag

SEQ ID NO: 120200 - DNA, 25 bp, B. subtillis
gctcgacaaaatttactcacattca

SEQ ID NO: 120201 - DNA, 25 bp, B. subtillis
atatgaatacgccaattctaccggg

SEQ ID NO: 120202 - DNA, 25 bp, B. subtillis
atttcttcatcgacattttccttcc

SEQ ID NO: 120203 - DNA, 25 bp, B. subtillis
ttttccattctacaccatggtaaaa

SEQ ID NO: 120204 - DNA, 25 bp, B. subtillis
tatcagtacgtcggcaatggaagaa

SEQ ID NO: 120205 - DNA, 25 bp, B. subtillis
tttggaggataggtcaggtgcgtta

SEQ ID NO: 120206 - DNA, 25 bp, B. subtillis
ggaggataggtcaggtgcgttatct

SEQ ID NO: 120207 - DNA, 25 bp, B. subtillis
gtgacactgtctatcagtacgtcgg

SEQ ID NO: 120208 - DNA, 25 bp, B. subtillis
gtagctgattctggaagcaacgttc

SEQ ID NO: 120209 - DNA, 25 bp, B. subtillis
tgacactgtctatcagtacgtcggc

SEQ ID NO: 120210 - DNA, 25 bp, B. subtillis
gattcagtagcagatgccgttcaaa

SEQ ID NO: 120211 - DNA, 25 bp, B. subtillis
ctggaagcaacgttctttccattca

SEQ ID NO: 120212 - DNA, 25 bp, B. subtillis
gcagatgccgttcaaaaggtcgatt

SEQ ID NO: 120213 - DNA, 25 bp, B. subtillis
aggtcgatttaagtagaagtgcgtt

SEQ ID NO: 120214 - DNA, 25 bp, B. subtillis
gtctgcattttcttggagaaattta

SEQ ID NO: 120215 - DNA, 25 bp, B. subtillis
tcaaaaattgagtcacgtccgacta

SEQ ID NO: 120216 - DNA, 25 bp, B. subtillis
tccggggcgctgcatagagtgctgt

SEQ ID NO: 120217 - DNA, 25 bp, B. subtillis
gagctctaggcccaaaacgacctta

SEQ ID NO: 120218 - DNA, 25 bp, B. subtillis
gagtcacgtccgactaaaaccggat

SEQ ID NO: 120219 - DNA, 25 bp, B. subtillis
cctgtcaaaaattgagtcacgtccg

SEQ ID NO: 120220 - DNA, 25 bp, B. subtillis
ctgtctcccgatgaaaacatatctt

SEQ ID NO: 120221 - DNA, 25 bp, B. subtillis
gaccatcccgagctgaatatcgggg

SEQ ID NO: 120222 - DNA, 25 bp, B. subtillis
ctgtcaaaaattgagtcacgtccga

SEQ ID NO: 120223 - DNA, 25 bp, B. subtillis
atcggggtcattgccaatgatatgg

SEQ ID NO: 120224 - DNA, 25 bp, B. subtillis
atggtcatgctgccgcaggatgatc

SEQ ID NO: 120225 - DNA, 25 bp, B. subtillis
tttcgatcttcataacggacaaact

SEQ ID NO: 120226 - DNA, 25 bp, B. subtillis
tacgcatgactacattacaacgggc

SEQ ID NO: 120227 - DNA, 25 bp, B. subtillis
tgactacattacaacgggccaggaa

SEQ ID NO: 120228 - DNA, 25 bp, B. subtillis
tccattgccatatcggctcgcaaat

SEQ ID NO: 120229 - DNA, 25 bp, B. subtillis
gactacattacaacgggccaggaag

SEQ ID NO: 120230 - DNA, 25 bp, B. subtillis
gaacgcatccactttcatggaaaca

SEQ ID NO: 120231 - DNA, 25 bp, B. subtillis
ctgaacgggccattgaacaagtatt

SEQ ID NO: 120232 - DNA, 25 bp, B. subtillis
cttcggatcacgcccggagtagaag

SEQ ID NO: 120233 - DNA, 25 bp, B. subtillis
gcttcttgaagacctatgtaaagaa

SEQ ID NO: 120234 - DNA, 25 bp, B. subtillis
agtttggtttcgatcttcataacgg

SEQ ID NO: 120235 - DNA, 25 bp, B. subtillis
actgaacgggccattgaacaagtat

SEQ ID NO: 120236 - DNA, 25 bp, B. subtillis
tacacctctttacgtatatgatgtg

SEQ ID NO: 120237 - DNA, 25 bp, B. subtillis
tagaaatcggaggtgtggatgctct

SEQ ID NO: 120238 - DNA, 25 bp, B. subtillis
ggagaaatatggtacacctctttac

SEQ ID NO: 120239 - DNA, 25 bp, B. subtillis
ggactttctttagatgtcgtatccg

SEQ ID NO: 120240 - DNA, 25 bp, B. subtillis
ggatgctctctatttagcggagaaa

SEQ ID NO: 120241 - DNA, 25 bp, B. subtillis
ggctttaatacgtgagcgtgctaaa

SEQ ID NO: 120242 - DNA, 25 bp, B. subtillis
gagagctatatacggctgttgcagc

SEQ ID NO: 120243 - DNA, 25 bp, B. subtillis
cacctctttacgtatatgatgtggc

SEQ ID NO: 120244 - DNA, 25 bp, B. subtillis
gcaggcgtttatttctgcagggctg

SEQ ID NO: 120245 - DNA, 25 bp, B. subtillis
atcagtcgcaatgattcagctcgct

SEQ ID NO: 120246 - DNA, 25 bp, B. subtillis
agcggagaaatatggtacacctctt

SEQ ID NO: 120247 - DNA, 25 bp, B. subtillis
tattcatttgtatccaaggtgctga

SEQ ID NO: 120248 - DNA, 25 bp, B. subtillis
ttcatttgtatccaaggtgctgaat

SEQ ID NO: 120249 - DNA, 25 bp, B. subtillis
ttgtatccaaggtgctgaatcttgg

SEQ ID NO: 120250 - DNA, 25 bp, B. subtillis
gtgctgaatcttggaggaggtttcg

SEQ ID NO: 120251 - DNA, 25 bp, B. subtillis
gttttgtgttagcagcggaaaaaat

SEQ ID NO: 120252 - DNA, 25 bp, B. subtillis
ggccggttttgtgttagcagcggaa

SEQ ID NO: 120253 - DNA, 25 bp, B. subtillis
tcatgccactgaatacgttgaaaaa

SEQ ID NO: 120254 - DNA, 25 bp, B. subtillis
gaaccgggccgttctctcgtgggag

SEQ ID NO: 120255 - DNA, 25 bp, B. subtillis
atgccactgaatacgttgaaaaaat

SEQ ID NO: 120256 - DNA, 25 bp, B. subtillis
atacggccggttttgtgttagcagc

SEQ ID NO: 120257 - DNA, 25 bp, B. subtillis
cgggccgttctctcgtgggagacgc

SEQ ID NO: 120258 - DNA, 25 bp, B. subtillis
gtcatttttttgcgcgacccgctga

SEQ ID NO: 120259 - DNA, 25 bp, B. subtillis
aaagaatcatgatctatacgcaacc

SEQ ID NO: 120260 - DNA, 25 bp, B. subtillis
tgaagattgatcagcttgtgtatgg

SEQ ID NO: 120261 - DNA, 25 bp, B. subtillis
tgaaccggatgtctcggcattaatc

SEQ ID NO: 120262 - DNA, 25 bp, B. subtillis
gaaaattgctttgatcgcgcatgac

SEQ ID NO: 120263 - DNA, 25 bp, B. subtillis
ccgtttatgtgatgtgtattccatt

SEQ ID NO: 120264 - DNA, 25 bp, B. subtillis
cccacagtgatgatgtcgagatcgg

SEQ ID NO: 120265 - DNA, 25 bp, B. subtillis
ccgaatgtataatgctgacgttctt

SEQ ID NO: 120266 - DNA, 25 bp, B. subtillis
ctgcggaaattcttgtgcgcacact

SEQ ID NO: 120267 - DNA, 25 bp, B. subtillis
gcggaaattcttgtgcgcacacttg

SEQ ID NO: 120268 - DNA, 25 bp, B. subtillis
atgaaggtgttttcgaattccgtga

SEQ ID NO: 120269 - DNA, 25 bp, B. subtillis
ttagagcacggagtccgtccagttg

SEQ ID NO: 120270 - DNA, 25 bp, B. subtillis
ggccatagaccatacatacgatcag

SEQ ID NO: 120271 - DNA, 25 bp, B. subtillis
acaaccggtttctcagaagctgatt

SEQ ID NO: 120272 - DNA, 25 bp, B. subtillis
acaaccggatgtcttgattgattta

SEQ ID NO: 120273 - DNA, 25 bp, B. subtillis
tcttgattgatttaacaacgcccga

SEQ ID NO: 120274 - DNA, 25 bp, B. subtillis
tcatcatgaccagaagcttgacgca

SEQ ID NO: 120275 - DNA, 25 bp, B. subtillis
gaaaaagggatcggagccatcatcg

SEQ ID NO: 120276 - DNA, 25 bp, B. subtillis
ccaaattttgcgctcggtgcgatac

SEQ ID NO: 120277 - DNA, 25 bp, B. subtillis
ctcggtgcgatactgatgatgaaat

SEQ ID NO: 120278 - DNA, 25 bp, B. subtillis
attatctgatgtgatgcctgttgag

SEQ ID NO: 120279 - DNA, 25 bp, B. subtillis
acaccacattttgaccttgtagggg

SEQ ID NO: 120280 - DNA, 25 bp, B. subtillis
ttcatcagccggattttgttattga

SEQ ID NO: 120281 - DNA, 25 bp, B. subtillis
ttccggcgcataaagtcagcaaggt

SEQ ID NO: 120282 - DNA, 25 bp, B. subtillis
gtacggtcagtttgcgtaaagaaga

SEQ ID NO: 120283 - DNA, 25 bp, B. subtillis
gatttgacagaagcggaactctctt

SEQ ID NO: 120284 - DNA, 25 bp, B. subtillis
aagaattcagctaacgcttccagac

SEQ ID NO: 120285 - DNA, 25 bp, B. subtillis
tatcccgtcaaaggattccgtttct

SEQ ID NO: 120286 - DNA, 25 bp, B. subtillis
tcatcagccggattttgttattgat

SEQ ID NO: 120287 - DNA, 25 bp, B. subtillis
gaagcgatcttttccgccggaatcc

SEQ ID NO: 120288 - DNA, 25 bp, B. subtillis
caattcggtcaattgtcactgtcat

SEQ ID NO: 120289 - DNA, 25 bp, B. subtillis
gctgaagcagcccgcatattaggcg

SEQ ID NO: 120290 - DNA, 25 bp, B. subtillis
atctcggatacaatagaggcaaaga

SEQ ID NO: 120291 - DNA, 25 bp, B. subtillis
tacacatctagcagtcagttcttgt

SEQ ID NO: 120292 - DNA, 25 bp, B. subtillis
ttatttaggtccagcagctacattt

SEQ ID NO: 120293 - DNA, 25 bp, B. subtillis
gtgtatagatgcagccgttgcaggc

SEQ ID NO: 120294 - DNA, 25 bp, B. subtillis
gggtgaaatgacgttgccgattcac

SEQ ID NO: 120295 - DNA, 25 bp, B. subtillis
gatgcagccgttgcaggcgaagttg

SEQ ID NO: 120296 - DNA, 25 bp, B. subtillis
acacgcgattgcgcaatgccataaa

SEQ ID NO: 120297 - DNA, 25 bp, B. subtillis
aatttactcacattcacacgcgatt

SEQ ID NO: 120298 - DNA, 25 bp, B. subtillis
tcaaaacggcgccgaacatgttgct

SEQ ID NO: 120299 - DNA, 25 bp, B. subtillis
tcacattcacacgcgattgcgcaat

SEQ ID NO: 120300 - DNA, 25 bp, B. subtillis
gagctcgacaaaatttactcacatt

SEQ ID NO: 120301 - DNA, 25 bp, B. subtillis
gaaatattaggttcaggtgcataag

SEQ ID NO: 120302 - DNA, 25 bp, B. subtillis
gacgttgccgattcaccagcacttg

SEQ ID NO: 120303 - DNA, 25 bp, B. subtillis
cacttgctcgtccatccctcaagag

SEQ ID NO: 120304 - DNA, 25 bp, B. subtillis
cgaacatgttgcttaccgcaccatt

SEQ ID NO: 120305 - DNA, 25 bp, B. subtillis
ctatttaatacatgaacagcctttg

SEQ ID NO: 120306 - DNA, 25 bp, B. subtillis
catgaacagcctttgccaatcgtgg

SEQ ID NO: 120307 - DNA, 25 bp, B. subtillis
ccgcaccattccggagtgtatagat

SEQ ID NO: 120308 - DNA, 25 bp, B. subtillis
gctacatttacacatctagcagtca

SEQ ID NO: 120309 - DNA, 25 bp, B. subtillis
attgcgcaatgccataaatttcttc

SEQ ID NO: 120310 - DNA, 25 bp, B. subtillis
aggtccagcagctacatttacacat

SEQ ID NO: 120311 - DNA, 25 bp, B. subtillis
taggtcaggtgcgttatctcagctt

SEQ ID NO: 120312 - DNA, 25 bp, B. subtillis
gtattgcccgatgcaatgagaaaaa

SEQ ID NO: 120313 - DNA, 25 bp, B. subtillis
ggaggataggtcaggtgcgttatct

SEQ ID NO: 120314 - DNA, 25 bp, B. subtillis
ggcggtagctgattctggaagcaac

SEQ ID NO: 120315 - DNA, 25 bp, B. subtillis
aagatgtattgcccgatgcaatgag

SEQ ID NO: 120316 - DNA, 25 bp, B. subtillis
tctttccattcaccagaccattccg

SEQ ID NO: 120317 - DNA, 25 bp, B. subtillis
tcttcaggcggtagctgattctgga

SEQ ID NO: 120318 - DNA, 25 bp, B. subtillis
tacagggatgctgtttttccattct

SEQ ID NO: 120319 - DNA, 25 bp, B. subtillis
gacattttatcttgtccgtgaagat

SEQ ID NO: 120320 - DNA, 25 bp, B. subtillis
cgcttcaaggcagagcaaatgtgac

SEQ ID NO: 120321 - DNA, 25 bp, B. subtillis
ctgattctggaagcaacgttctttc

SEQ ID NO: 120322 - DNA, 25 bp, B. subtillis
ccattccgcttcaaggcagagcaaa

SEQ ID NO: 120323 - DNA, 25 bp, B. subtillis
cactgtctatcagtacgtcggcaat

SEQ ID NO: 120324 - DNA, 25 bp, B. subtillis
cagtagcagatgccgttcaaaaggt

SEQ ID NO: 120325 - DNA, 25 bp, B. subtillis
ctcagcttcttcaggcggtagctga

SEQ ID NO: 120326 - DNA, 25 bp, B. subtillis
gcaaatgtgacactgtctatcagta

SEQ ID NO: 120327 - DNA, 25 bp, B. subtillis
gcgttatctcagcttcttcaggcgg

SEQ ID NO: 120328 - DNA, 25 bp, B. subtillis
atcttgtccgtgaagatgtattgcc

SEQ ID NO: 120329 - DNA, 25 bp, B. subtillis
accagaccattccgcttcaaggcag

SEQ ID NO: 120330 - DNA, 25 bp, B. subtillis
agcagattcagtagcagatgccgtt

SEQ ID NO: 120331 - DNA, 25 bp, B. subtillis
tatcggggtcattgccaatgatatg

SEQ ID NO: 120332 - DNA, 25 bp, B. subtillis
ttaatggtcatgctgccgcaggatg

SEQ ID NO: 120333 - DNA, 25 bp, B. subtillis
gtgctgtctgcattttcttggagaa

SEQ ID NO: 120334 - DNA, 25 bp, B. subtillis
gtcagtgaccatcccgagctgaata

SEQ ID NO: 120335 - DNA, 25 bp, B. subtillis
ggatgatcagtccggggcgctgcat

SEQ ID NO: 120336 - DNA, 25 bp, B. subtillis
gtattgattccaggggccatgcagg

SEQ ID NO: 120337 - DNA, 25 bp, B. subtillis
aagtttgtcagtgaccatcccgagc

SEQ ID NO: 120338 - DNA, 25 bp, B. subtillis
tgatgatgtattgattccaggggcc

SEQ ID NO: 120339 - DNA, 25 bp, B. subtillis
gagctgaatatcggggtcattgcca

SEQ ID NO: 120340 - DNA, 25 bp, B. subtillis
ctgtctcccgatgaaaacatatctt

SEQ ID NO: 120341 - DNA, 25 bp, B. subtillis
gccaatgatatggcagcttctacat

SEQ ID NO: 120342 - DNA, 25 bp, B. subtillis
ccatcccgagctgaatatcggggtc

SEQ ID NO: 120343 - DNA, 25 bp, B. subtillis
cttctgggtgcataccagtcttacc

SEQ ID NO: 120344 - DNA, 25 bp, B. subtillis
ctgcatagagtgctgtctgcatttt

SEQ ID NO: 120345 - DNA, 25 bp, B. subtillis
gaattcaaaattgagctctaggccc

SEQ ID NO: 120346 - DNA, 25 bp, B. subtillis
cggggcgctgcatagagtgctgtct

SEQ ID NO: 120347 - DNA, 25 bp, B. subtillis
atggcagcttctacatacgaattaa

SEQ ID NO: 120348 - DNA, 25 bp, B. subtillis
aggggccatgcaggagcttgaagca

SEQ ID NO: 120349 - DNA, 25 bp, B. subtillis
catgctgccgcaggatgatcagtcc

SEQ ID NO: 120350 - DNA, 25 bp, B. subtillis
agtgaggcttctgggtgcataccag

SEQ ID NO: 120351 - DNA, 25 bp, B. subtillis
ttcggatcacgcccggagtagaagc

SEQ ID NO: 120352 - DNA, 25 bp, B. subtillis
tagaagcgcatacgcatgactacat

SEQ ID NO: 120353 - DNA, 25 bp, B. subtillis
gtcactccatcgatgttcttcttcg

SEQ ID NO: 120354 - DNA, 25 bp, B. subtillis
ggataatttctatgaaatcgcgctt

SEQ ID NO: 120355 - DNA, 25 bp, B. subtillis
aacacattcagctgctgggtgtcca

SEQ ID NO: 120356 - DNA, 25 bp, B. subtillis
aatcggaacacattcagctgctggg

SEQ ID NO: 120357 - DNA, 25 bp, B. subtillis
aatcgcgcttcttgaagacctatgt

SEQ ID NO: 120358 - DNA, 25 bp, B. subtillis
tcgatcttcataacggacaaactga

SEQ ID NO: 120359 - DNA, 25 bp, B. subtillis
gatcacgcccggagtagaagcgcat

SEQ ID NO: 120360 - DNA, 25 bp, B. subtillis
cattcagctgctgggtgtccattgc

SEQ ID NO: 120361 - DNA, 25 bp, B. subtillis
ctatgaaatcgcgcttcttgaagac

SEQ ID NO: 120362 - DNA, 25 bp, B. subtillis
cgcttgagcaccgcatcggctgcat

SEQ ID NO: 120363 - DNA, 25 bp, B. subtillis
gcatcggctgcattgtggtggataa

SEQ ID NO: 120364 - DNA, 25 bp, B. subtillis
gatggcgcttgagcaccgcatcggc

SEQ ID NO: 120365 - DNA, 25 bp, B. subtillis
gcaccgcatcggctgcattgtggtg

SEQ ID NO: 120366 - DNA, 25 bp, B. subtillis
atacgcatgactacattacaacggg

SEQ ID NO: 120367 - DNA, 25 bp, B. subtillis
atttctatgaaatcgcgcttcttga

SEQ ID NO: 120368 - DNA, 25 bp, B. subtillis
attacaatcggaacacattcagctg

SEQ ID NO: 120369 - DNA, 25 bp, B. subtillis
agcgcatacgcatgactacattaca

SEQ ID NO: 120370 - DNA, 25 bp, B. subtillis
agctgctgggtgtccattgccatat

SEQ ID NO: 120371 - DNA, 25 bp, B. subtillis
tttatttctgcagggctgaaagcac

SEQ ID NO: 120372 - DNA, 25 bp, B. subtillis
tttaagcaggcgtttatttctgcag

SEQ ID NO: 120373 - DNA, 25 bp, B. subtillis
tagaaatcggaggtgtggatgctct

SEQ ID NO: 120374 - DNA, 25 bp, B. subtillis
gtatatgatgtggctttaatacgtg

SEQ ID NO: 120375 - DNA, 25 bp, B. subtillis
gggctgaaagcacaggtggcatatg

SEQ ID NO: 120376 - DNA, 25 bp, B. subtillis
ggagagctatatacggctgttgcag

SEQ ID NO: 120377 - DNA, 25 bp, B. subtillis
tggtacacctctttacgtatatgat

SEQ ID NO: 120378 - DNA, 25 bp, B. subtillis
tggatgctctctatttagcggagaa

SEQ ID NO: 120379 - DNA, 25 bp, B. subtillis
ggcatatgcgagcaaagcattctca

SEQ ID NO: 120380 - DNA, 25 bp, B. subtillis
tctttagatgtcgtatccggaggag

SEQ ID NO: 120381 - DNA, 25 bp, B. subtillis
tcgcaatgattcagctcgctgagga

SEQ ID NO: 120382 - DNA, 25 bp, B. subtillis
catcagtcgcaatgattcagctcgc

SEQ ID NO: 120383 - DNA, 25 bp, B. subtillis
cacctctttacgtatatgatgtggc

SEQ ID NO: 120384 - DNA, 25 bp, B. subtillis
cattctcatcagtcgcaatgattca

SEQ ID NO: 120385 - DNA, 25 bp, B. subtillis
gcagacaaaatcaacatggtcattt

SEQ ID NO: 120386 - DNA, 25 bp, B. subtillis
gcaggcgtttatttctgcagggctg

SEQ ID NO: 120387 - DNA, 25 bp, B. subtillis
gcaaagcattctcatcagtcgcaat

SEQ ID NO: 120388 - DNA, 25 bp, B. subtillis
atgcgagcaaagcattctcatcagt

SEQ ID NO: 120389 - DNA, 25 bp, B. subtillis
aggtgtggatgctctctatttagcg

SEQ ID NO: 120390 - DNA, 25 bp, B. subtillis
atgtcgtatccggaggagagctata

SEQ ID NO: 120391 - DNA, 25 bp, B. subtillis
tattcgttatacggaagatgatgaa

SEQ ID NO: 120392 - DNA, 25 bp, B. subtillis
tttgtatccaaggtgctgaatcttg

SEQ ID NO: 120393 - DNA, 25 bp, B. subtillis
tggagagattcatattcatttgtat

SEQ ID NO: 120394 - DNA, 25 bp, B. subtillis
tgggagacgcaggcacaactcttta

SEQ ID NO: 120395 - DNA, 25 bp, B. subtillis
accgcttcatgccactgaatacgtt

SEQ ID NO: 120396 - DNA, 25 bp, B. subtillis
aatcgtttcatcattcggcgtgcga

SEQ ID NO: 120397 - DNA, 25 bp, B. subtillis
aagatgatgaaccgcttcatgccac

SEQ ID NO: 120398 - DNA, 25 bp, B. subtillis
tatccaaggtgctgaatcttggagg

SEQ ID NO: 120399 - DNA, 25 bp, B. subtillis
tgaaccgcttcatgccactgaatac

SEQ ID NO: 120400 - DNA, 25 bp, B. subtillis
tacaatcgtttcatcattcggcgtg

SEQ ID NO: 120401 - DNA, 25 bp, B. subtillis
gagacgcaggcacaactctttatac

SEQ ID NO: 120402 - DNA, 25 bp, B. subtillis
catttgtatccaaggtgctgaatct

SEQ ID NO: 120403 - DNA, 25 bp, B. subtillis
ctgtacaatcgtttcatcattcggc

SEQ ID NO: 120404 - DNA, 25 bp, B. subtillis
cgtttcatcattcggcgtgcgaatt

SEQ ID NO: 120405 - DNA, 25 bp, B. subtillis
catattcatttgtatccaaggtgct

SEQ ID NO: 120406 - DNA, 25 bp, B. subtillis
gcacaactctttatacggttggctc

SEQ ID NO: 120407 - DNA, 25 bp, B. subtillis
attcatattcatttgtatccaaggt

SEQ ID NO: 120408 - DNA, 25 bp, B. subtillis
ataagctgtacaatcgtttcatcat

SEQ ID NO: 120409 - DNA, 25 bp, B. subtillis
atgatgaaccgcttcatgccactga

SEQ ID NO: 120410 - DNA, 25 bp, B. subtillis
agctgtacaatcgtttcatcattcg

SEQ ID NO: 120411 - DNA, 25 bp, B. subtillis
ttcatgaggcgacaggtcttcaaat

SEQ ID NO: 120412 - DNA, 25 bp, B. subtillis
gatgtctcggcattaatccgtttat

SEQ ID NO: 120413 - DNA, 25 bp, B. subtillis
aaattcttgtgcgcacacttgatga

SEQ ID NO: 120414 - DNA, 25 bp, B. subtillis
tcatgatctatacgcaaccggaacc

SEQ ID NO: 120415 - DNA, 25 bp, B. subtillis
tgatgtgtattccattccgctcgcc

SEQ ID NO: 120416 - DNA, 25 bp, B. subtillis
tgaaaattgctttgatcgcgcatga

SEQ ID NO: 120417 - DNA, 25 bp, B. subtillis
tcaatttacgactgcctatcgggat

SEQ ID NO: 120418 - DNA, 25 bp, B. subtillis
tgcactgatcgctgccaatgcactc

SEQ ID NO: 120419 - DNA, 25 bp, B. subtillis
cattaatccgtttatgtgatgtgta

SEQ ID NO: 120420 - DNA, 25 bp, B. subtillis
cacagtgatgatgtcgagatcggaa

SEQ ID NO: 120421 - DNA, 25 bp, B. subtillis
gctcgccacaaatatgggtactgcg

SEQ ID NO: 120422 - DNA, 25 bp, B. subtillis
catgtcaggcgttaaactgtcagtc

SEQ ID NO: 120423 - DNA, 25 bp, B. subtillis
cccgctgaccgcgcagccgcatgaa

SEQ ID NO: 120424 - DNA, 25 bp, B. subtillis
gctgccaatgcactcgatcttgtca

SEQ ID NO: 120425 - DNA, 25 bp, B. subtillis
gcttttggcgcccacagtgatgatg

SEQ ID NO: 120426 - DNA, 25 bp, B. subtillis
gcgcacacttgatgaaggtgttttc

SEQ ID NO: 120427 - DNA, 25 bp, B. subtillis
atgaagattgatcagcttgtgtatg

SEQ ID NO: 120428 - DNA, 25 bp, B. subtillis
atgctgacgttcttgcttttggcgc

SEQ ID NO: 120429 - DNA, 25 bp, B. subtillis
aggatatggttcaatttacgactgc

SEQ ID NO: 120430 - DNA, 25 bp, B. subtillis
agcaaatcggtgcactgatcgctgc

SEQ ID NO: 120431 - DNA, 25 bp, B. subtillis
tatctgatgtgatgcctgttgagtc

SEQ ID NO: 120432 - DNA, 25 bp, B. subtillis
ttgagtcagatgctttcatttacac

SEQ ID NO: 120433 - DNA, 25 bp, B. subtillis
gtgatgcctgttgagtcagatgctt

SEQ ID NO: 120434 - DNA, 25 bp, B. subtillis
tggcagaacgaacaccacattttga

SEQ ID NO: 120435 - DNA, 25 bp, B. subtillis
gatatccatgcctgttttacagaaa

SEQ ID NO: 120436 - DNA, 25 bp, B. subtillis
aaattttgcgctcggtgcgatactg

SEQ ID NO: 120437 - DNA, 25 bp, B. subtillis
aaaaattgcattagagcacggagtc

SEQ ID NO: 120438 - DNA, 25 bp, B. subtillis
tgccaactattttgaggatgttgag

SEQ ID NO: 120439 - DNA, 25 bp, B. subtillis
tacacagatatccatgcctgtttta

SEQ ID NO: 120440 - DNA, 25 bp, B. subtillis
tgctttcatttacacagatatccat

SEQ ID NO: 120441 - DNA, 25 bp, B. subtillis
tcatcgcgccaaattttgcgctcgg

SEQ ID NO: 120442 - DNA, 25 bp, B. subtillis
gagccatcatcgcgccaaattttgc

SEQ ID NO: 120443 - DNA, 25 bp, B. subtillis
gagattattgagcttcatcatgacc

SEQ ID NO: 120444 - DNA, 25 bp, B. subtillis
caagcggaactgcgcttaaaacagc

SEQ ID NO: 120445 - DNA, 25 bp, B. subtillis
cgctcggtgcgatactgatgatgaa

SEQ ID NO: 120446 - DNA, 25 bp, B. subtillis
catgaccagaagcttgacgcaccaa

SEQ ID NO: 120447 - DNA, 25 bp, B. subtillis
gaagcttgacgcaccaagcggaact

SEQ ID NO: 120448 - DNA, 25 bp, B. subtillis
agcagcaaggacatccggatgaaaa

SEQ ID NO: 120449 - DNA, 25 bp, B. subtillis
agcttcatcatgaccagaagcttga

SEQ ID NO: 120450 - DNA, 25 bp, B. subtillis
agggatcggagccatcatcgcgcca

SEQ ID NO: 120451 - DNA, 25 bp, B. subtillis
ttttgttattgatatctcggataca

SEQ ID NO: 120452 - DNA, 25 bp, B. subtillis
ttgatatctcggatacaatagaggc

SEQ ID NO: 120453 - DNA, 25 bp, B. subtillis
gtcactgtcatcagaatctgtcggc

SEQ ID NO: 120454 - DNA, 25 bp, B. subtillis
tgatcaggcaattcggtcaattgtc

SEQ ID NO: 120455 - DNA, 25 bp, B. subtillis
ggtatattgaaatcgttgaagcgag

SEQ ID NO: 120456 - DNA, 25 bp, B. subtillis
ggcaatgcggctgcactggtggaag

SEQ ID NO: 120457 - DNA, 25 bp, B. subtillis
gataaatggttttcatcagccggat

SEQ ID NO: 120458 - DNA, 25 bp, B. subtillis
aatgagtgatcaggcaattcggtca

SEQ ID NO: 120459 - DNA, 25 bp, B. subtillis
aagaattcagctaacgcttccagac

SEQ ID NO: 120460 - DNA, 25 bp, B. subtillis
tccggatcacggcaatgcggctgca

SEQ ID NO: 120461 - DNA, 25 bp, B. subtillis
tcaattgtcactgtcatcagaatct

SEQ ID NO: 120462 - DNA, 25 bp, B. subtillis
catcagaatctgtcggccaaaagcg

SEQ ID NO: 120463 - DNA, 25 bp, B. subtillis
ctactcctctgacgaatgggtatat

SEQ ID NO: 120464 - DNA, 25 bp, B. subtillis
gccttccggcgcataaagtcagcaa

SEQ ID NO: 120465 - DNA, 25 bp, B. subtillis
gcagcccgcatattaggcgcagata

SEQ ID NO: 120466 - DNA, 25 bp, B. subtillis
gctgaagcagcccgcatattaggcg

SEQ ID NO: 120467 - DNA, 25 bp, B. subtillis
gaagcagctgaagcagcccgcatat

SEQ ID NO: 120468 - DNA, 25 bp, B. subtillis
attcggtcaattgtcactgtcatca

SEQ ID NO: 120469 - DNA, 25 bp, B. subtillis
agaagaagcagctgaagcagcccgc

SEQ ID NO: 120470 - DNA, 25 bp, B. subtillis
aggatcgccatccggatcacggcaa

SEQ ID NO: 120471 - DNA, 25 bp, P1 bacteriophage
gcggcatggtgcaagttgaataacc

SEQ ID NO: 120472 - DNA, 25 bp, P1 bacteriophage
aatgctgtttcactggttatgcggc

SEQ ID NO: 120473 - DNA, 25 bp, P1 bacteriophage
atgccggtgaacgtgcaaaacaggc

SEQ ID NO: 120474 - DNA, 25 bp, P1 bacteriophage
acgtgcaaaacaggctctagcgttc

SEQ ID NO: 120475 - DNA, 25 bp, P1 bacteriophage
ccgggctgccacgaccaagtgacag

SEQ ID NO: 120476 - DNA, 25 bp, P1 bacteriophage
tcgttcactcatggaaaatagcgat

SEQ ID NO: 120477 - DNA, 25 bp, P1 bacteriophage
gccaggcgttttctgagcatacctg

SEQ ID NO: 120478 - DNA, 25 bp, P1 bacteriophage
tcagggttaaagatatctcacgtac

SEQ ID NO: 120479 - DNA, 25 bp, P1 bacteriophage
gacatgttcagggatcgccaggcgt

SEQ ID NO: 120480 - DNA, 25 bp, P1 bacteriophage
gcaagaacctgatggacatgttcag

SEQ ID NO: 120481 - DNA, 25 bp, P1 bacteriophage
gagtgatgaggttcgcaagaacctg

SEQ ID NO: 120482 - DNA, 25 bp, P1 bacteriophage
taccggtcgatgcaacgagtgatga

SEQ ID NO: 120483 - DNA, 25 bp, P1 bacteriophage
atttgcctgcattaccggtcgatgc

SEQ ID NO: 120484 - DNA, 25 bp, P1 bacteriophage
atggaaaatagcgatcgctgccagg

SEQ ID NO: 120485 - DNA, 25 bp, P1 bacteriophage
ccagctaaacatgcttcatcgtcgg

SEQ ID NO: 120486 - DNA, 25 bp, P1 bacteriophage
gaccaagtgacagcaatgctgtttc

SEQ ID NO: 120487 - DNA, 25 bp, P1 bacteriophage
ctctagcgttcgaacgcactgattt

SEQ ID NO: 120488 - DNA, 25 bp, P1 bacteriophage
tctatatcttcaggcgcgcggtctg

SEQ ID NO: 120489 - DNA, 25 bp, P1 bacteriophage
gaagatgttcgcgattatcttctat

SEQ ID NO: 120490 - DNA, 25 bp, P1 bacteriophage
gcaacatttgggccagctaaacatg

SEQ ID NO: 120491 - DNA, 25 bp, P1 bacteriophage
tggtcgagcgatggatttccgtctc

SEQ ID NO: 120492 - DNA, 25 bp, P1 bacteriophage
caccgcaggtgtagagaaggcactt

SEQ ID NO: 120493 - DNA, 25 bp, P1 bacteriophage
cgctggttagcaccgcaggtgtaga

SEQ ID NO: 120494 - DNA, 25 bp, P1 bacteriophage
gattgatttacggcgctaaggatga

SEQ ID NO: 120495 - DNA, 25 bp, P1 bacteriophage
taaggatgactctggtcagagatac

SEQ ID NO: 120496 - DNA, 25 bp, P1 bacteriophage
ggagatcatgcaagctggtggctgg

SEQ ID NO: 120497 - DNA, 25 bp, P1 bacteriophage
tggtcagagatacctggcctggtct

SEQ ID NO: 120498 - DNA, 25 bp, P1 bacteriophage
ctggtctggacacagtgcccgtgtc

SEQ ID NO: 120499 - DNA, 25 bp, P1 bacteriophage
ttgtcatgaactatatccgtaacct

SEQ ID NO: 120500 - DNA, 25 bp, P1 bacteriophage
gtgcccgtgtcggagccgcgcgaga

SEQ ID NO: 120501 - DNA, 25 bp, P1 bacteriophage
tagtgaaacaggggcaatggtgcgc

SEQ ID NO: 120502 - DNA, 25 bp, P1 bacteriophage
gcaactcatcgattgatttacggcg

SEQ ID NO: 120503 - DNA, 25 bp, P1 bacteriophage
atggatttccgtctctggtgtagct

SEQ ID NO: 120504 - DNA, 25 bp, P1 bacteriophage
ccaatgtaaatattgtcatgaacta

SEQ ID NO: 120505 - DNA, 25 bp, P1 bacteriophage
tgtagctgatgatccgaataactac

SEQ ID NO: 120506 - DNA, 25 bp, P1 bacteriophage
ctggtggctggaccaatgtaaatat

SEQ ID NO: 120507 - DNA, 25 bp, P1 bacteriophage
accagccagctatcaactcgcgccc

SEQ ID NO: 120508 - DNA, 25 bp, P1 bacteriophage
gtctctggtgtagctgatgatccga

SEQ ID NO: 120509 - DNA, 25 bp, P1 bacteriophage
ggagtttcaataccggagatcatgc

SEQ ID NO: 120510 - DNA, 25 bp, P1 bacteriophage
cgagatatggcccgcgctggagttt

SEQ ID NO: 120511 - DNA, 25 bp, E. coli
gcaaaggcagcaggctaccggacgg

SEQ ID NO: 120512 - DNA, 25 bp, E. coli
cagcagcctgcagctggattacgca

SEQ ID NO: 120513 - DNA, 25 bp, E. coli
agcgcaacagcagcctgcagctgga

SEQ ID NO: 120514 - DNA, 25 bp, E. coli
cgttacagcgcaacagcagcctgca

SEQ ID NO: 120515 - DNA, 25 bp, E. coli
gcgctggcgttacagcgcaacagca

SEQ ID NO: 120516 - DNA, 25 bp, E. coli
ctgcagctggattacgcaacagtaa

SEQ ID NO: 120517 - DNA, 25 bp, E. coli
aggtttacgcaatagcgacgcgctg

SEQ ID NO: 120518 - DNA, 25 bp, E. coli
cgcaatagcgacgcgctggcgttac

SEQ ID NO: 120519 - DNA, 25 bp, E. coli
caagccgcaaaggcagcaggctacc

SEQ ID NO: 120520 - DNA, 25 bp, E. coli
cacttttacaagccgcaaaggcagc

SEQ ID NO: 120521 - DNA, 25 bp, E. coli
cgccagttgtgcacttttacaagcc

SEQ ID NO: 120522 - DNA, 25 bp, E. coli
gggaaaactgtcgccagttgtgcac

SEQ ID NO: 120523 - DNA, 25 bp, E. coli
gcgacgcgctggcgttacagcgcaa

SEQ ID NO: 120524 - DNA, 25 bp, E. coli
cgcaagagggcagaccgatagaatc

SEQ ID NO: 120525 - DNA, 25 bp, E. coli
gggcagaccgatagaatcattggta

SEQ ID NO: 120526 - DNA, 25 bp, E. coli
gaccgatagaatcattggtaatgag

SEQ ID NO: 120527 - DNA, 25 bp, E. coli
agaatcattggtaatgagcgccgga

SEQ ID NO: 120528 - DNA, 25 bp, E. coli
ttggtaatgagcgccggattacgcg

SEQ ID NO: 120529 - DNA, 25 bp, E. coli
catcagcgcgcaagagggcagaccg

SEQ ID NO: 120530 - DNA, 25 bp, E. coli
atgagcgccggattacgcgcgcttg

SEQ ID NO: 120531 - DNA, 25 bp, E. coli
gagatcccctggcttgcagaaaatc

SEQ ID NO: 120532 - DNA, 25 bp, E. coli
ctgctgggagagatcccctggcttg

SEQ ID NO: 120533 - DNA, 25 bp, E. coli
atcccctggcttgcagaaaatccag

SEQ ID NO: 120534 - DNA, 25 bp, E. coli
catgattcccgcgccgctgctggga

SEQ ID NO: 120535 - DNA, 25 bp, E. coli
ccgctgctgggagagatcccctggc

SEQ ID NO: 120536 - DNA, 25 bp, E. coli
ggagagatcccctggcttgcagaaa

SEQ ID NO: 120537 - DNA, 25 bp, E. coli
gaatatatgaccacgctcacccgca

SEQ ID NO: 120538 - DNA, 25 bp, E. coli
gattcccgcgccgctgctgggagag

SEQ ID NO: 120539 - DNA, 25 bp, E. coli
cgcgccgctgctgggagagatcccc

SEQ ID NO: 120540 - DNA, 25 bp, E. coli
cgtcacgctgaatatatgaccacgc

SEQ ID NO: 120541 - DNA, 25 bp, E. coli
acgctgaatatatgaccacgctcac

SEQ ID NO: 120542 - DNA, 25 bp, E. coli
gctgggagagatcccctggcttgca

SEQ ID NO: 120543 - DNA, 25 bp, E. coli
ctgaatatatgaccacgctcacccg

SEQ ID NO: 120544 - DNA, 25 bp, E. coli
cccgcatgattcccgcgccgctgct

SEQ ID NO: 120545 - DNA, 25 bp, E. coli
ctttctgacactttcacttttgcag

SEQ ID NO: 120546 - DNA, 25 bp, E. coli
tttgcagattgggtaacacaggaac

SEQ ID NO: 120547 - DNA, 25 bp, E. coli
gaaaacgtcacgctgaatatatgac

SEQ ID NO: 120548 - DNA, 25 bp, E. coli
tgacactttcacttttgcagattgg

SEQ ID NO: 120549 - DNA, 25 bp, E. coli
ggtgctggcggctggtttacgccgc

SEQ ID NO: 120550 - DNA, 25 bp, E. coli
aaacgtcacgctgaatatatgacca

SEQ ID NO: 120551 - DNA, 25 bp, E. coli
gccttagatctctcgccgccaatgc

SEQ ID NO: 120552 - DNA, 25 bp, E. coli
tgagccgccactggcgggaacgtca

SEQ ID NO: 120553 - DNA, 25 bp, E. coli
gggttgtggacctggctggatgagc

SEQ ID NO: 120554 - DNA, 25 bp, E. coli
tactggcaatgcttccacagcgtaa

SEQ ID NO: 120555 - DNA, 25 bp, E. coli
gagtgctgacgccttactggcaatg

SEQ ID NO: 120556 - DNA, 25 bp, E. coli
tacagcgccagagtgctgacgcctt

SEQ ID NO: 120557 - DNA, 25 bp, E. coli
aacatgcagatctacagcgccagag

SEQ ID NO: 120558 - DNA, 25 bp, E. coli
gatcttgcatggagcaatctcgcag

SEQ ID NO: 120559 - DNA, 25 bp, E. coli
caatctcgcagtgcagtggtgcggt

SEQ ID NO: 120560 - DNA, 25 bp, E. coli
cagcggcatttggtcgggcagccgc

SEQ ID NO: 120561 - DNA, 25 bp, E. coli
cgcacactatgagcaacatgcagat

SEQ ID NO: 120562 - DNA, 25 bp, E. coli
gtcgggcagccgcacactatgagca

SEQ ID NO: 120563 - DNA, 25 bp, E. coli
gccgcagaccattatctggcgggag

SEQ ID NO: 120564 - DNA, 25 bp, E. coli
agaaggatgccgcagaccattatct

SEQ ID NO: 120565 - DNA, 25 bp, E. coli
gcgcaggtgacggccttagatctct

SEQ ID NO: 120566 - DNA, 25 bp, E. coli
atttatccacggcactccgcgagct

SEQ ID NO: 120567 - DNA, 25 bp, E. coli
cgacgttcgatcttgcatggagcaa

SEQ ID NO: 120568 - DNA, 25 bp, E. coli
cgttagcgactgcgacgttcgatct

SEQ ID NO: 120569 - DNA, 25 bp, E. coli
gccgccaatgcttgttcaggcacgc

SEQ ID NO: 120570 - DNA, 25 bp, E. coli
tgttcaggcacgccagaaggatgcc

SEQ ID NO: 120571 - DNA, 25 bp, E. coli
aacagtcgctgaacggcgtgcatta

SEQ ID NO: 120572 - DNA, 25 bp, E. coli
gatgaaatcgaacagtcgctgaacg

SEQ ID NO: 120573 - DNA, 25 bp, E. coli
atgatgcgctcagtgccatgcgttc

SEQ ID NO: 120574 - DNA, 25 bp, E. coli
ggtggacgagcgtccgcatgctaat

SEQ ID NO: 120575 - DNA, 25 bp, E. coli
tgccacgcatcttcatgaagggcgc

SEQ ID NO: 120576 - DNA, 25 bp, E. coli
ctcagtgccatgcgttcgctgaaag

SEQ ID NO: 120577 - DNA, 25 bp, E. coli
catgcgttcgctgaaaggcatcggt

SEQ ID NO: 120578 - DNA, 25 bp, E. coli
ctgaaaggcatcggtgccacgcatc

SEQ ID NO: 120579 - DNA, 25 bp, E. coli
atcttcatgaagggcgcgacccgcg

SEQ ID NO: 120580 - DNA, 25 bp, E. coli
tttaccgccagatgaaatcgaacag

SEQ ID NO: 120581 - DNA, 25 bp, E. coli
cgtccgcatgctaatcgctttttac

SEQ ID NO: 120582 - DNA, 25 bp, E. coli
acatcatattcagcccatcacgctg

SEQ ID NO: 120583 - DNA, 25 bp, E. coli
tacccgaacgtcatcaggcgtggca

SEQ ID NO: 120584 - DNA, 25 bp, E. coli
gcgttcgcagttgcagcgattgcaa

SEQ ID NO: 120585 - DNA, 25 bp, E. coli
agttgcagcgattgcaactggcctg

SEQ ID NO: 120586 - DNA, 25 bp, E. coli
ggcatcggtgccacgcatcttcatg

SEQ ID NO: 120587 - DNA, 25 bp, E. coli
atcacgctgtggtttgatgatgcgc

SEQ ID NO: 120588 - DNA, 25 bp, E. coli
attaacgcgttcgcagttgcagcga

SEQ ID NO: 120589 - DNA, 25 bp, E. coli
ggtttgatgatgcgctcagtgccat

SEQ ID NO: 120590 - DNA, 25 bp, E. coli
ttcagcccatcacgctgtggtttga

SEQ ID NO: 120591 - DNA, 25 bp, E. coli
gcaatatcatcaccacacgcactta

SEQ ID NO: 120592 - DNA, 25 bp, E. coli
aagatcgcgccggattattgctgca

SEQ ID NO: 120593 - DNA, 25 bp, E. coli
atacgctggaaaaagtgcgcgatgc

SEQ ID NO: 120594 - DNA, 25 bp, E. coli
aagcgtgccaatcaacatgctggtg

SEQ ID NO: 120595 - DNA, 25 bp, E. coli
caatcaacatgctggtgaaggtgaa

SEQ ID NO: 120596 - DNA, 25 bp, E. coli
gttttacggcaatatcatcaccaca

SEQ ID NO: 120597 - DNA, 25 bp, E. coli
attgctgcaactggcaaacctgccg

SEQ ID NO: 120598 - DNA, 25 bp, E. coli
acgcacttatcaggaacgcctcgat

SEQ ID NO: 120599 - DNA, 25 bp, E. coli
acgatgatgtcgatgcctttgattt

SEQ ID NO: 120600 - DNA, 25 bp, E. coli
ttgccgataacgatgatgtcgatgc

SEQ ID NO: 120601 - DNA, 25 bp, E. coli
tggtgaaggtgaaaggcacgccgct

SEQ ID NO: 120602 - DNA, 25 bp, E. coli
ggaaaaagtgcgcgatgccgggatc

SEQ ID NO: 120603 - DNA, 25 bp, E. coli
aagtctgttctggcggcattgtggg

SEQ ID NO: 120604 - DNA, 25 bp, E. coli
gccgggatcaaagtctgttctggcg

SEQ ID NO: 120605 - DNA, 25 bp, E. coli
atcaccacacgcacttatcaggaac

SEQ ID NO: 120606 - DNA, 25 bp, E. coli
cgccggaaagcgtgccaatcaacat

SEQ ID NO: 120607 - DNA, 25 bp, E. coli
agtgcgcgatgccgggatcaaagtc

SEQ ID NO: 120608 - DNA, 25 bp, E. coli
gccggattattgctgcaactggcaa

SEQ ID NO: 120609 - DNA, 25 bp, E. coli
gccggagttttacggcaatatcatc

SEQ ID NO: 120610 - DNA, 25 bp, E. coli
acgccgcttgccgataacgatgatg

SEQ ID NO: 120611 - DNA, 25 bp, E. coli
agcttgtccggaagattgcaaatac

SEQ ID NO: 120612 - DNA, 25 bp, E. coli
gcaggtgcatcgccagcatttcgat

SEQ ID NO: 120613 - DNA, 25 bp, E. coli
agattgcaaatactgcccgcaaacg

SEQ ID NO: 120614 - DNA, 25 bp, E. coli
caaatactgcccgcaaacgtcgcgc

SEQ ID NO: 120615 - DNA, 25 bp, E. coli
gcgcagcaggtgcatcgccagcatt

SEQ ID NO: 120616 - DNA, 25 bp, E. coli
attgtcgcaagtcacagaattattt

SEQ ID NO: 120617 - DNA, 25 bp, E. coli
ggatctgctgtttgaagcgcagcag

SEQ ID NO: 120618 - DNA, 25 bp, E. coli
ggagtcggcgcgcaaagcgaaagcg

SEQ ID NO: 120619 - DNA, 25 bp, E. coli
gttgctggatctgctgtttgaagcg

SEQ ID NO: 120620 - DNA, 25 bp, E. coli
gacattgtcgcaagtcacagaatta

SEQ ID NO: 120621 - DNA, 25 bp, E. coli
ggcaggatcgacgcgcttctgtatg

SEQ ID NO: 120622 - DNA, 25 bp, E. coli
gcaggtcagcacgttgctgtcgatt

SEQ ID NO: 120623 - DNA, 25 bp, E. coli
tcgtcaggtgcaggtcagcacgttg

SEQ ID NO: 120624 - DNA, 25 bp, E. coli
cgatcctcgtcaggtgcaggtcagc

SEQ ID NO: 120625 - DNA, 25 bp, E. coli
tgaacaggtgctggagtcggcgcgc

SEQ ID NO: 120626 - DNA, 25 bp, E. coli
gcatttcgatcctcgtcaggtgcag

SEQ ID NO: 120627 - DNA, 25 bp, E. coli
caaagcgaaagcggcaggatcgacg

SEQ ID NO: 120628 - DNA, 25 bp, E. coli
gctgtcgattaagaccggagcttgt

SEQ ID NO: 120629 - DNA, 25 bp, E. coli
gcatcgccagcatttcgatcctcgt

SEQ ID NO: 120630 - DNA, 25 bp, E. coli
cagcacgttgctgtcgattaagacc

SEQ ID NO: 120631 - DNA, 25 bp, E. coli
gcgcctttctgccggacgcgagcag

SEQ ID NO: 120632 - DNA, 25 bp, E. coli
atggcaggcgcaaactcgattttct

SEQ ID NO: 120633 - DNA, 25 bp, E. coli
gtgctttatggcaggcgcaaactcg

SEQ ID NO: 120634 - DNA, 25 bp, E. coli
aacagactcaggcgatgtgctttat

SEQ ID NO: 120635 - DNA, 25 bp, E. coli
gatgaacgaacagactcaggcgatg

SEQ ID NO: 120636 - DNA, 25 bp, E. coli
gccggacgcgagcagatgaacgaac

SEQ ID NO: 120637 - DNA, 25 bp, E. coli
tcaggcgatgtgctttatggcaggc

SEQ ID NO: 120638 - DNA, 25 bp, E. coli
tgccaacctcttacgtgcgcctttc

SEQ ID NO: 120639 - DNA, 25 bp, E. coli
ggatcatgatgccaacctcttacgt

SEQ ID NO: 120640 - DNA, 25 bp, E. coli
ggtcgcgcggatcatgatgccaacc

SEQ ID NO: 120641 - DNA, 25 bp, E. coli
atattacaacgcggcagcattatga

SEQ ID NO: 120642 - DNA, 25 bp, E. coli
cgagcagatgaacgaacagactcag

SEQ ID NO: 120643 - DNA, 25 bp, E. coli
cgtcttgaacaggcgctgatgaccc

SEQ ID NO: 120644 - DNA, 25 bp, E. coli
tacggttgcaaactgctgaccacgc

SEQ ID NO: 120645 - DNA, 25 bp, E. coli
gggctaaatccgcagcaaactgccg

SEQ ID NO: 120646 - DNA, 25 bp, E. coli
acagcaacgtcttgaacaggcgctg

SEQ ID NO: 120647 - DNA, 25 bp, E. coli
caaactgctgaccacgccgaatccg

SEQ ID NO: 120648 - DNA, 25 bp, E. coli
gacctgcaactgttccgcaaactgg

SEQ ID NO: 120649 - DNA, 25 bp, E. coli
cgcagcaaactgccgtgctggcagg

SEQ ID NO: 120650 - DNA, 25 bp, E. coli
acaggcgctgatgaccccggacacc

SEQ ID NO: 120651 - DNA, 25 bp, S. cerevisiae
tttgctccacacaatatagatggat

SEQ ID NO: 120652 - DNA, 25 bp, S. cerevisiae
gtggcgtcgctgaaccatagcaggc

SEQ ID NO: 120653 - DNA, 25 bp, S. cerevisiae
gtctgatcaggcattgccgcgaagc

SEQ ID NO: 120654 - DNA, 25 bp, S. cerevisiae
gtccttgtggcgtcgctgaaccata

SEQ ID NO: 120655 - DNA, 25 bp, S. cerevisiae
tgggtgcttgctggcgaattgcaat

SEQ ID NO: 120656 - DNA, 25 bp, S. cerevisiae
ggattatggctgaacgcctctaagt

SEQ ID NO: 120657 - DNA, 25 bp, S. cerevisiae
tggctgaacgcctctaagtcagaat

SEQ ID NO: 120658 - DNA, 25 bp, S. cerevisiae
aacgcctctaagtcagaatccatgc

SEQ ID NO: 120659 - DNA, 25 bp, S. cerevisiae
tcgctgaaccatagcaggctagcaa

SEQ ID NO: 120660 - DNA, 25 bp, S. cerevisiae
tgctggcgaattgcaatgtcatttt

SEQ ID NO: 120661 - DNA, 25 bp, S. cerevisiae
tcaggcattgccgcgaagctaccat

SEQ ID NO: 120662 - DNA, 25 bp, S. cerevisiae
tccatgctagaacgcggtgatttct

SEQ ID NO: 120663 - DNA, 25 bp, S. cerevisiae
taattggtttttgcggctgtctgat

SEQ ID NO: 120664 - DNA, 25 bp, S. cerevisiae
taaggcgtccttgtggcgtcgctga

SEQ ID NO: 120665 - DNA, 25 bp, S. cerevisiae
tcagaatccatgctagaacgcggtg

SEQ ID NO: 120666 - DNA, 25 bp, S. cerevisiae
cttgctggcgaattgcaatgtcatt

SEQ ID NO: 120667 - DNA, 25 bp, S. cerevisiae
cgcggtgatttctttgctccacaca

SEQ ID NO: 120668 - DNA, 25 bp, S. cerevisiae
gcgaagctaccatccgctggattat

SEQ ID NO: 120669 - DNA, 25 bp, S. cerevisiae
attgccgcgaagctaccatccgctg

SEQ ID NO: 120670 - DNA, 25 bp, S. cerevisiae
aggccttgggtgcttgctggcgaat

SEQ ID NO: 120671 - DNA, 25 bp, S. cerevisiae
agcaggctagcaacggtgcacttgg

SEQ ID NO: 120672 - DNA, 25 bp, S. cerevisiae
tactatctagcgaaaccacagccaa

SEQ ID NO: 120673 - DNA, 25 bp, S. cerevisiae
ttgagcttgactctagtttgacatt

SEQ ID NO: 120674 - DNA, 25 bp, S. cerevisiae
ttgactctagtttgacattgtgaag

SEQ ID NO: 120675 - DNA, 25 bp, S. cerevisiae
tgggagcttcggcgccagtgaaata

SEQ ID NO: 120676 - DNA, 25 bp, S. cerevisiae
ggtagccaaatgcctcgtcatctaa

SEQ ID NO: 120677 - DNA, 25 bp, S. cerevisiae
tggcagaatcagcggggaaagaaga

SEQ ID NO: 120678 - DNA, 25 bp, S. cerevisiae
actgtccctatctactatctagcga

SEQ ID NO: 120679 - DNA, 25 bp, S. cerevisiae
accctgttgagcttgactctagttt

SEQ ID NO: 120680 - DNA, 25 bp, S. cerevisiae
caatgaagcggagctggaattcatt

SEQ ID NO: 120681 - DNA, 25 bp, S. cerevisiae
taactatgactctcttaaggtagcc

SEQ ID NO: 120682 - DNA, 25 bp, S. cerevisiae
tctttacttattcaatgaagcggag

SEQ ID NO: 120683 - DNA, 25 bp, S. cerevisiae
tgactctcttaaggtagccaaatgc

SEQ ID NO: 120684 - DNA, 25 bp, S. cerevisiae
cctcgtcatctaattagtgacgcgc

SEQ ID NO: 120685 - DNA, 25 bp, S. cerevisiae
ctagtttgacattgtgaagagacat

SEQ ID NO: 120686 - DNA, 25 bp, S. cerevisiae
cttattcaatgaagcggagctggaa

SEQ ID NO: 120687 - DNA, 25 bp, S. cerevisiae
catctaattagtgacgcgcatgaat

SEQ ID NO: 120688 - DNA, 25 bp, S. cerevisiae
cctatctactatctagcgaaaccac

SEQ ID NO: 120689 - DNA, 25 bp, S. cerevisiae
attagtgacgcgcatgaatggatta

SEQ ID NO: 120690 - DNA, 25 bp, S. cerevisiae
cttcggcgccagtgaaataccacta

SEQ ID NO: 120691 - DNA, 25 bp, S. cerevisiae
agggaacgggcttggcagaatcagc

SEQ ID NO: 120692 - DNA, 25 bp, S. cerevisiae
ttatgcaggccaccatcgaaaggga

SEQ ID NO: 120693 - DNA, 25 bp, S. cerevisiae
gtaacgtaactgaatgtggagacgt

SEQ ID NO: 120694 - DNA, 25 bp, S. cerevisiae
ggatatggattcttcacggtaacgt

SEQ ID NO: 120695 - DNA, 25 bp, S. cerevisiae
gttagtcgatcctaagagatgggga

SEQ ID NO: 120696 - DNA, 25 bp, S. cerevisiae
gttaagattccggaacctggatatg

SEQ ID NO: 120697 - DNA, 25 bp, S. cerevisiae
aaaggcctgattttatgcaggccac

SEQ ID NO: 120698 - DNA, 25 bp, S. cerevisiae
aatgtggagacgtcggcgcgagccc

SEQ ID NO: 120699 - DNA, 25 bp, S. cerevisiae
tcttatggctggaagaggccagcac

SEQ ID NO: 120700 - DNA, 25 bp, S. cerevisiae
taacagcttatcaccccggaattgg

SEQ ID NO: 120701 - DNA, 25 bp, S. cerevisiae
tgacggcccgtgaaaatccacagga

SEQ ID NO: 120702 - DNA, 25 bp, S. cerevisiae
ctgattttatgcaggccaccatcga

SEQ ID NO: 120703 - DNA, 25 bp, S. cerevisiae
ccggtgcgcttgtgacggcccgtga

SEQ ID NO: 120704 - DNA, 25 bp, S. cerevisiae
cgtttcaaaggcctgattttatgca

SEQ ID NO: 120705 - DNA, 25 bp, S. cerevisiae
cctttgctggctccggtgcgcttgt

SEQ ID NO: 120706 - DNA, 25 bp, S. cerevisiae
ctggctccggtgcgcttgtgacggc

SEQ ID NO: 120707 - DNA, 25 bp, S. cerevisiae
cgtgaaaatccacaggaaggaatag

SEQ ID NO: 120708 - DNA, 25 bp, S. cerevisiae
cgatcctaagagatggggaagctcc

SEQ ID NO: 120709 - DNA, 25 bp, S. cerevisiae
gtttatccggagatggggtcttatg

SEQ ID NO: 120710 - DNA, 25 bp, S. cerevisiae
tcttcttaacagcttatcaccccgg

SEQ ID NO: 120711 - DNA, 25 bp, S. cerevisiae
attccggaacctggatatggattct

SEQ ID NO: 120712 - DNA, 25 bp, S. cerevisiae
atcttttcttcttaacagcttatca

SEQ ID NO: 120713 - DNA, 25 bp, S. cerevisiae
tagtagctggttcctgccgaagttt

SEQ ID NO: 120714 - DNA, 25 bp, S. cerevisiae
gtgcaaatcgatcgtcgaatttggg

SEQ ID NO: 120715 - DNA, 25 bp, S. cerevisiae
accatctagtagctggttcctgccg

SEQ ID NO: 120716 - DNA, 25 bp, S. cerevisiae
aatcgaccgatcctgatgtcttcgg

SEQ ID NO: 120717 - DNA, 25 bp, S. cerevisiae
aatcgaaccatctagtagctggttc

SEQ ID NO: 120718 - DNA, 25 bp, S. cerevisiae
aagactaatcgaaccatctagtagc

SEQ ID NO: 120719 - DNA, 25 bp, S. cerevisiae
taagagcatagctgttgggacccga

SEQ ID NO: 120720 - DNA, 25 bp, S. cerevisiae
tccctcaggatagcagaagctcgta

SEQ ID NO: 120721 - DNA, 25 bp, S. cerevisiae
tcttcggatggatttgagtaagagc

SEQ ID NO: 120722 - DNA, 25 bp, S. cerevisiae
tgaccttgacctattctcaaacttt

SEQ ID NO: 120723 - DNA, 25 bp, S. cerevisiae
ctgatgtcttcggatggatttgagt

SEQ ID NO: 120724 - DNA, 25 bp, S. cerevisiae
ctatgcctgaatagggtgaagccag

SEQ ID NO: 120725 - DNA, 25 bp, S. cerevisiae
cctgccgaagtttccctcaggatag

SEQ ID NO: 120726 - DNA, 25 bp, S. cerevisiae
ccgatcctgatgtcttcggatggat

SEQ ID NO: 120727 - DNA, 25 bp, S. cerevisiae
gctcgtagcggttctgacgtgcaaa

SEQ ID NO: 120728 - DNA, 25 bp, S. cerevisiae
gaagtttccctcaggatagcagaag

SEQ ID NO: 120729 - DNA, 25 bp, S. cerevisiae
gcagaagctcgtatcagttttatga

SEQ ID NO: 120730 - DNA, 25 bp, S. cerevisiae
gctcgtatcagttttatgaggtaaa

SEQ ID NO: 120731 - DNA, 25 bp, S. cerevisiae
atcgatcgtcgaatttgggtatagg

SEQ ID NO: 120732 - DNA, 25 bp, S. cerevisiae
agcggttctgacgtgcaaatcgatc

SEQ ID NO: 120733 - DNA, 25 bp, S. cerevisiae
tacccgctgaacttaagcatatcaa

SEQ ID NO: 120734 - DNA, 25 bp, S. cerevisiae
taggagtacccgctgaacttaagca

SEQ ID NO: 120735 - DNA, 25 bp, S. cerevisiae
gtgccttcgaagagtcgagttgttt

SEQ ID NO: 120736 - DNA, 25 bp, S. cerevisiae
ggtgcccgagttgtaatttggagag

SEQ ID NO: 120737 - DNA, 25 bp, S. cerevisiae
gtaaattccatctaaagctaaatat

SEQ ID NO: 120738 - DNA, 25 bp, S. cerevisiae
tgacctcaaatcaggtaggagtacc

SEQ ID NO: 120739 - DNA, 25 bp, S. cerevisiae
gattgccttagtaacggcgagtgaa

SEQ ID NO: 120740 - DNA, 25 bp, S. cerevisiae
acaggacgtcatagagggtgagaat

SEQ ID NO: 120741 - DNA, 25 bp, S. cerevisiae
aaagtgccttcgaagagtcgagttg

SEQ ID NO: 120742 - DNA, 25 bp, S. cerevisiae
aagagtcgagttgtttgggaatgca

SEQ ID NO: 120743 - DNA, 25 bp, S. cerevisiae
aacggcgagtgaagcggcaaaagct

SEQ ID NO: 120744 - DNA, 25 bp, S. cerevisiae
tctggtaccttcggtgcccgagttg

SEQ ID NO: 120745 - DNA, 25 bp, S. cerevisiae
cttggaacaggacgtcatagagggt

SEQ ID NO: 120746 - DNA, 25 bp, S. cerevisiae
cgagttgtttgggaatgcagctcta

SEQ ID NO: 120747 - DNA, 25 bp, S. cerevisiae
ctgaacttaagcatatcaataagcg

SEQ ID NO: 120748 - DNA, 25 bp, S. cerevisiae
ttgtctatgttccttggaacaggac

SEQ ID NO: 120749 - DNA, 25 bp, S. cerevisiae
attggcgagagaccgatagcgaaca

SEQ ID NO: 120750 - DNA, 25 bp, S. cerevisiae
atattggcgagagaccgatagcgaa

SEQ ID NO: 120751 - DNA, 25 bp, S. cerevisiae
atcaggtaggagtacccgctgaact

SEQ ID NO: 120752 - DNA, 25 bp, S. cerevisiae
agcatatcaataagcggaggaaaag

SEQ ID NO: 120753 - DNA, 25 bp, S. cerevisiae
agctcaaatttgaaatctggtacct

SEQ ID NO: 120754 - DNA, 25 bp, S. cerevisiae
ttagtgaggcctcaggatctgctta

SEQ ID NO: 120755 - DNA, 25 bp, S. cerevisiae
tagacgttctgggccgcacgcgcgc

SEQ ID NO: 120756 - DNA, 25 bp, S. cerevisiae
ttctgggccgcacgcgcgctacact

SEQ ID NO: 120757 - DNA, 25 bp, S. cerevisiae
ttgtaattattgctcttcaacgagg

SEQ ID NO: 120758 - DNA, 25 bp, S. cerevisiae
gggggcaactccatctcagagcgga

SEQ ID NO: 120759 - DNA, 25 bp, S. cerevisiae
tggacaaacttggtcatttagagga

SEQ ID NO: 120760 - DNA, 25 bp, S. cerevisiae
aatggcttagtgaggcctcaggatc

SEQ ID NO: 120761 - DNA, 25 bp, S. cerevisiae
aactccatctcagagcggagaattt

SEQ ID NO: 120762 - DNA, 25 bp, S. cerevisiae
aatcttgtgaaactccgtcgtgctg

SEQ ID NO: 120763 - DNA, 25 bp, S. cerevisiae
tgacggagccagcgagtctaacctt

SEQ ID NO: 120764 - DNA, 25 bp, S. cerevisiae
ctagtaagcgcaagtcatcagcttg

SEQ ID NO: 120765 - DNA, 25 bp, S. cerevisiae
cgtcgctagtaccgattgaatggct

SEQ ID NO: 120766 - DNA, 25 bp, S. cerevisiae
gccgcacgcgcgctacactgacgga

SEQ ID NO: 120767 - DNA, 25 bp, S. cerevisiae
ctgtgatgcccttagacgttctggg

SEQ ID NO: 120768 - DNA, 25 bp, S. cerevisiae
cgattgaatggcttagtgaggcctc

SEQ ID NO: 120769 - DNA, 25 bp, S. cerevisiae
cagcttgcgttgattacgtccctgc

SEQ ID NO: 120770 - DNA, 25 bp, S. cerevisiae
cgcgcgctacactgacggagccagc

SEQ ID NO: 120771 - DNA, 25 bp, S. cerevisiae
gaattcctagtaagcgcaagtcatc

SEQ ID NO: 120772 - DNA, 25 bp, S. cerevisiae
aggcctcaggatctgcttagagaag

SEQ ID NO: 120773 - DNA, 25 bp, S. cerevisiae
agtcatcagcttgcgttgattacgt

SEQ ID NO: 120774 - DNA, 25 bp, S. cerevisiae
ttatccacttcttagagggactatc

SEQ ID NO: 120775 - DNA, 25 bp, S. cerevisiae
ttagttggtggagtgatttgtctgc

SEQ ID NO: 120776 - DNA, 25 bp, S. cerevisiae
gtgatttgtctgcttaattgcgata

SEQ ID NO: 120777 - DNA, 25 bp, S. cerevisiae
ggtgctagcatttgctggttatcca

SEQ ID NO: 120778 - DNA, 25 bp, S. cerevisiae
ggtggtgcatggccgttcttagttg

SEQ ID NO: 120779 - DNA, 25 bp, S. cerevisiae
gtccagacacaataaggattgacag

SEQ ID NO: 120780 - DNA, 25 bp, S. cerevisiae
tgtctgcttaattgcgataacgaac

SEQ ID NO: 120781 - DNA, 25 bp, S. cerevisiae
tggtcgcaaggctgaaacttaaagg

SEQ ID NO: 120782 - DNA, 25 bp, S. cerevisiae
gattgagagctctttcttgattttg

SEQ ID NO: 120783 - DNA, 25 bp, S. cerevisiae
aatagtggtgctagcatttgctggt

SEQ ID NO: 120784 - DNA, 25 bp, S. cerevisiae
tgctggttatccacttcttagaggg

SEQ ID NO: 120785 - DNA, 25 bp, S. cerevisiae
gagtggagcctgcggcttaatttga

SEQ ID NO: 120786 - DNA, 25 bp, S. cerevisiae
gagctctttcttgattttgtgggtg

SEQ ID NO: 120787 - DNA, 25 bp, S. cerevisiae
gaaactcaccaggtccagacacaat

SEQ ID NO: 120788 - DNA, 25 bp, S. cerevisiae
caccaggagtggagcctgcggctta

SEQ ID NO: 120789 - DNA, 25 bp, S. cerevisiae
caccaggtccagacacaataaggat

SEQ ID NO: 120790 - DNA, 25 bp, S. cerevisiae
ctactaaatagtggtgctagcattt

SEQ ID NO: 120791 - DNA, 25 bp, S. cerevisiae
gcatggccgttcttagttggtggag

SEQ ID NO: 120792 - DNA, 25 bp, S. cerevisiae
agcctgcggcttaatttgactcaac

SEQ ID NO: 120793 - DNA, 25 bp, S. cerevisiae
agcatttgctggttatccacttctt

SEQ ID NO: 120794 - DNA, 25 bp, S. cerevisiae
tttctaggaccatcgtaatgattaa

SEQ ID NO: 120795 - DNA, 25 bp, S. cerevisiae
tgtggctcttggcgaaccaggactt

SEQ ID NO: 120796 - DNA, 25 bp, S. cerevisiae
tgttggtttctaggaccatcgtaat

SEQ ID NO: 120797 - DNA, 25 bp, S. cerevisiae
tggtttctaggaccatcgtaatgat

SEQ ID NO: 120798 - DNA, 25 bp, S. cerevisiae
aagatgatcagataccgtcgtagtc

SEQ ID NO: 120799 - DNA, 25 bp, S. cerevisiae
aactactgcgaaagcatttgccaag

SEQ ID NO: 120800 - DNA, 25 bp, S. cerevisiae
aagactaactactgcgaaagcattt

SEQ ID NO: 120801 - DNA, 25 bp, S. cerevisiae
tgttcaaagcaggcgtattgctcga

SEQ ID NO: 120802 - DNA, 25 bp, S. cerevisiae
ttgaagactaactactgcgaaagca

SEQ ID NO: 120803 - DNA, 25 bp, S. cerevisiae
tgcgaaagcatttgccaaggacgtt

SEQ ID NO: 120804 - DNA, 25 bp, S. cerevisiae
tgccaaggacgttttcattaatcaa

SEQ ID NO: 120805 - DNA, 25 bp, S. cerevisiae
gagtgttcaaagcaggcgtattgct

SEQ ID NO: 120806 - DNA, 25 bp, S. cerevisiae
ccttgtggctcttggcgaaccagga

SEQ ID NO: 120807 - DNA, 25 bp, S. cerevisiae
cttaaccataaactatgccgactag

SEQ ID NO: 120808 - DNA, 25 bp, S. cerevisiae
ctaaccttgagtccttgtggctctt

SEQ ID NO: 120809 - DNA, 25 bp, S. cerevisiae
atgatcagataccgtcgtagtctta

SEQ ID NO: 120810 - DNA, 25 bp, S. cerevisiae
atcagtattcaattgtcagaggtga

SEQ ID NO: 120811 - DNA, 25 bp, S. cerevisiae
agcatttgccaaggacgttttcatt

SEQ ID NO: 120812 - DNA, 25 bp, S. cerevisiae
actatgccgactagggatcgggtgg

SEQ ID NO: 120813 - DNA, 25 bp, S. cerevisiae
agtattcaattgtcagaggtgaaat

SEQ ID NO: 120814 - DNA, 25 bp, S. cerevisiae
agtccttgtggctcttggcgaacca

SEQ ID NO: 120815 - DNA, 25 bp, S. cerevisiae
ttggagggcaagtctggtgccagca

SEQ ID NO: 120816 - DNA, 25 bp, S. cerevisiae
ggtgccagcagccgcggtaattcca

SEQ ID NO: 120817 - DNA, 25 bp, S. cerevisiae
tctggtgccagcagccgcggtaatt

SEQ ID NO: 120818 - DNA, 25 bp, S. cerevisiae
ggcgcgcaaattacccaatcctaat

SEQ ID NO: 120819 - DNA, 25 bp, S. cerevisiae
gagggcaagtctggtgccagcagcc

SEQ ID NO: 120820 - DNA, 25 bp, S. cerevisiae
taattcagggaggtagtgacaataa

SEQ ID NO: 120821 - DNA, 25 bp, S. cerevisiae
aagtctggtgccagcagccgcggta

SEQ ID NO: 120822 - DNA, 25 bp, S. cerevisiae
tcctaattcagggaggtagtgacaa

SEQ ID NO: 120823 - DNA, 25 bp, S. cerevisiae
cgcggtaattccagctccaatagcg

SEQ ID NO: 120824 - DNA, 25 bp, S. cerevisiae
catccaaggaaggcagcaggcgcgc

SEQ ID NO: 120825 - DNA, 25 bp, S. cerevisiae
ccaaggaaggcagcaggcgcgcaaa

SEQ ID NO: 120826 - DNA, 25 bp, S. cerevisiae
aattccagctccaatagcgtatatt

SEQ ID NO: 120827 - DNA, 25 bp, S. cerevisiae
caattggagggcaagtctggtgcca

SEQ ID NO: 120828 - DNA, 25 bp, S. cerevisiae
ctaccacatccaaggaaggcagcag

SEQ ID NO: 120829 - DNA, 25 bp, S. cerevisiae
gcagcaggcgcgcaaattacccaat

SEQ ID NO: 120830 - DNA, 25 bp, S. cerevisiae
gcaggcgcgcaaattacccaatcct

SEQ ID NO: 120831 - DNA, 25 bp, S. cerevisiae
aggaaggcagcaggcgcgcaaatta

SEQ ID NO: 120832 - DNA, 25 bp, S. cerevisiae
cggctaccacatccaaggaaggcag

SEQ ID NO: 120833 - DNA, 25 bp, S. cerevisiae
agccgcggtaattccagctccaata

SEQ ID NO: 120834 - DNA, 25 bp, S. cerevisiae
agcagccgcggtaattccagctcca

SEQ ID NO: 120835 - DNA, 25 bp, S. cerevisiae
tttatacagtgaaactgcgaatggc

SEQ ID NO: 120836 - DNA, 25 bp, S. cerevisiae
ttttcgaatcgcatggccttgtgct

SEQ ID NO: 120837 - DNA, 25 bp, S. cerevisiae
tcaactttcgatggtaggatagtgg

SEQ ID NO: 120838 - DNA, 25 bp, S. cerevisiae
aaatcagttatcgtttatttgatag

SEQ ID NO: 120839 - DNA, 25 bp, S. cerevisiae
aatctcgaccctttggaagagatgt

SEQ ID NO: 120840 - DNA, 25 bp, S. cerevisiae
aactgcgaatggctcattaaatcag

SEQ ID NO: 120841 - DNA, 25 bp, S. cerevisiae
tcttcggactctttgatgattcata

SEQ ID NO: 120842 - DNA, 25 bp, S. cerevisiae
tcaatgtcttcggactctttgatga

SEQ ID NO: 120843 - DNA, 25 bp, S. cerevisiae
taggatagtggcctaccatggtttc

SEQ ID NO: 120844 - DNA, 25 bp, S. cerevisiae
gactctttgatgattcataataact

SEQ ID NO: 120845 - DNA, 25 bp, S. cerevisiae
ccatgcatgtctaagtataagcaat

SEQ ID NO: 120846 - DNA, 25 bp, S. cerevisiae
catatgcttgtctcaaagattaagc

SEQ ID NO: 120847 - DNA, 25 bp, S. cerevisiae
cttgtctcaaagattaagccatgca

SEQ ID NO: 120848 - DNA, 25 bp, S. cerevisiae
gaatggctcattaaatcagttatcg

SEQ ID NO: 120849 - DNA, 25 bp, S. cerevisiae
atacatgcttaaaatctcgaccctt

SEQ ID NO: 120850 - DNA, 25 bp, S. cerevisiae
ataactgtggtaattctagagctaa

SEQ ID NO: 120851 - DNA, 25 bp, S. cerevisiae
attaagccatgcatgtctaagtata

SEQ ID NO: 120852 - DNA, 25 bp, S. cerevisiae
attcaaatttctgccctatcaactt

SEQ ID NO: 120853 - DNA, 25 bp, S. cerevisiae
atttctgccctatcaactttcgatg

SEQ ID NO: 120854 - DNA, 25 bp, S. cerevisiae
agtagtcatatgcttgtctcaaaga

SEQ ID NO: 120855 - DNA, 25 bp, S. cerevisiae
atggccttgtgctggcgatggttca
